(12) United States Patent
Bermudez et al.

(10) Patent No.: US 7,737,117 B2
(45) Date of Patent: Jun. 15, 2010

(54) ***BACILLUS THURINGIENSIS* CRYSTAL POLYPEPTIDES, POLYNUCLEOTIDES, AND COMPOSITIONS THEREOF**

(75) Inventors: Ericka Bermudez, Aptos, CA (US); Robin Emig, Belmont, CA (US); Kevin McBride, Davis, CA (US); Takashi Yamamoto, Fremont, CA (US)

(73) Assignee: Pioneer Hi-Bred International, Inc., Johnston, IA (US)

( * ) Notice: Subject to any disclaimer, the term of this patent is extended or adjusted under 35 U.S.C. 154(b) by 495 days.

(21) Appl. No.: 11/675,729

(22) Filed: Feb. 16, 2007

(65) Prior Publication Data

US 2007/0202089 A1 Aug. 30, 2007

Related U.S. Application Data

(62) Division of application No. 11/067,557, filed on Feb. 25, 2005, now Pat. No. 7,208,474.

(60) Provisional application No. 60/547,664, filed on Feb. 25, 2004.

(51) Int. Cl.
*C07K 14/00* (2006.01)
*C12N 1/20* (2006.01)
*C12P 21/02* (2006.01)

(52) U.S. Cl. ............... 514/12; 435/252.3; 435/70.1; 530/350

(58) Field of Classification Search .............. None
See application file for complete search history.

(56) References Cited

U.S. PATENT DOCUMENTS 5,545,818 A 8/1996 McBride et al.
5,753,492 A 5/1998 Schnepf et al.
2003/0167517 A1 9/2003 Arnaut et al.

FOREIGN PATENT DOCUMENTS

WO WO 00/26371 5/2000
WO WO 02/057665 A2 7/2002

OTHER PUBLICATIONS

Widner et al., Two Highly Related Insecticidal Crystal Proteins of *Bacillus thuringiensis subsp.* kurstaki Possess Different Host Range Specificities, Journal of Bacteriology, 1989, vol. 171, pp. 965-974.*
Bosch et al., Recombinant *Bacillus thuringiensis* crystal proteins with new properties: possibilities for resistance management, Biotechnology, (1994), 12:915-918.
Crickmore et al., Revision of the nomenclature for the *Bacillus thuringiensis* pesticidal crystal proteins, Microbiology and Molecular Biology Reviews, (1998), 62:807-813.
de Maagd et al., Domain III substitution in *Bacillus thuringiensis* delta-endotoxin CryIA(b) results in superior toxicity for *Spodoptera exigua* and altered membrane protein recognition, Applied and Environmental Microbiology, (1996), 62:1537-1543.
Jellis et al., Molecular biology of *Bacillus thuringiensis* and potential benefits to agriculture, Israel Journal of Entomology, (1989), XXIII:189-199.
Lee et al., Resistance to *Bacillus thuringiensis* CrylA delta-endotoxins in a laboratory-selected Heliothis virescens strain is related to receptor alteration, Applied and Environmental Microbiology (1995), 61:3836-3842.
Morse et al., Structure of Cry2Aa suggests an unexpected receptor binding epitope, Structure, (2001), 9:409-417.

* cited by examiner

*Primary Examiner*—David J Steadman
*Assistant Examiner*—Alexander D Kim

(57) ABSTRACT

The present invention provides insecticidal polypeptides related to *Bacillus* Cry2 polypeptides. Nucleic acids encoding the polypeptides of the invention are also provided. Methods for using the polypeptides and nucleic acids of the invention to enhance resistance of plants to insect predation are encompassed.

11 Claims, 4 Drawing Sheets

Figure 1:
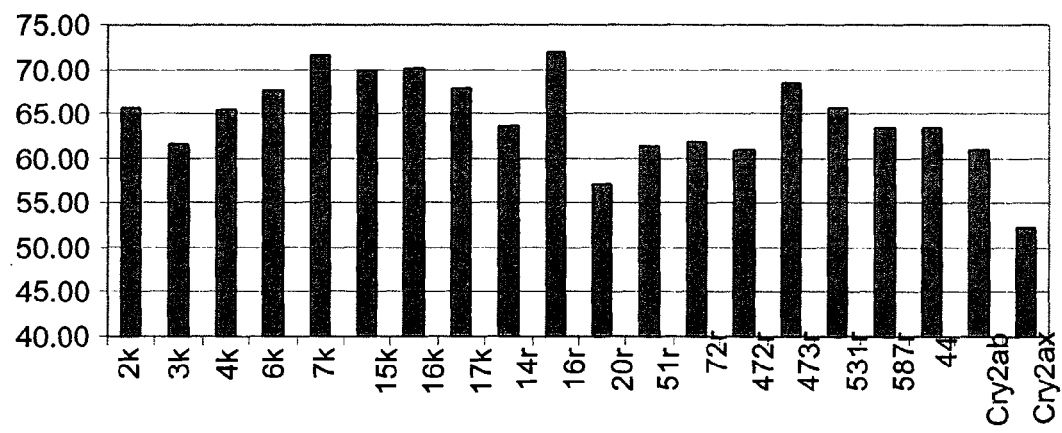

BACILLUS THURINGIENSIS CRYSTAL POLYPEPTIDES, POLYNUCLEOTIDES, AND COMPOSITIONS THEREOF

This application is a divisional of, and claims benefit to, U.S. application Ser. No. 11/067,557, filed Feb. 25, 2005, now U.S. Pat. No. 7,208,474, which claims priority to and benefit of U.S. provisional application No. 60/547,664, filed Feb. 25, 2004, both of which are incorporated herein by reference in their entirety.

1. FIELD OF THE INVENTION

The present invention relates generally to the field of pest control and provides insecticidal polypeptides related to *Bacillus* Cry2 polypeptides and the polynucleotides that encode them. The present invention also relates to methods and compositions for altering resistance of plants to insect predation including, but not limited to, transgenic plant production.

2. BACKGROUND OF THE INVENTION

Numerous commercially valuable plants, including common agricultural crops, are susceptible to attack by insect and nematode pests. These pests can cause substantial reductions in crop yield and quality. Traditionally, farmers have relied heavily on chemical pesticides to combat pest damage. However, the use of chemical pesticides raises its own set of problems, including the cost and inconvenience of applying the pesticides. Furthermore, chemical residues raise environmental and health concerns. For these and other reasons there is a demand for alternative insecticidal agents.

An environmentally friendly approach to controlling pests is the use of pesticidal crystal proteins derived from the soil bacterium *Bacillus thuringiensis* ("Bt"), commonly referred to as "Cry proteins." Many of these proteins are quite toxic to specific target insects, but harmless to plants and other non-targeted organisms. Some Cry proteins have been recombinantly expressed in crop plants to provide pest-resistant transgenic plants. Among those, Bt-transgenic cotton and corn have been widely cultivated.

A large number of Cry proteins have been isolated, characterized and classified based on amino acid sequence homology (Crickmore et al., 1998, *Microbiol. Mol. Biol. Rev.*, 62: 807-813). This classification scheme provides a systematic mechanism for naming and categorizing newly discovered Cry proteins.

It has generally been found that individual Cry proteins possess relatively narrow activity spectra with the exception of Cry2A. Cry2A is unusual in that this subset of Cry proteins possesses a broader effective range that includes toxicity to both the Lepidoptera and Diptera orders of insects. The Cry2A protein was discovered to be a toxin showing a dual activity against *Trichoplusia ni* (cabbage looper) and *Aedes taeniorhynchus* (mosquito) (Yamamoto and McLaughlin, 1982, *Biochem. Biophys. Res. Comm.* 130: 414-421). The nucleic acid molecule encoding the Cry2A protein (termed Cry2Aa) was cloned and expressed in *B. megaterium* and found to be active against both Lepidoptera and Diptera insects (Donovan et al. 1988, *J. Bacteriol.* 170: 4732-4738). An additional coding sequence homologous to Cry2Aa was cloned (termed Cry2Ab) and was found to be active only against Lepidoptera larvae (Widner and Whiteley, 1989, *J Bacteriol* 171:2).

Second generation transgenic crops could be more resistant to insects if they are able to express multiple and/or novel Bt genes. Accordingly, new insecticidal proteins having broad activity spectra would be highly desirable.

3. SUMMARY OF THE INVENTION

The present invention relates to a novel Cry2 polypeptide, Cry2Ax (SEQ ID NO:2), isolated from *Bacillus thuringiensis*. Also encompassed by the present invention are Cry2Ax-derived polypeptides (SEQ ID NOS:4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260). In addition to the polypeptide sequence of Cry2Ax and Cry2Ax-derived polypeptides, it will be appreciated that polypeptides of the invention also encompass variants thereof, including, but not limited to, any fragment, analog, homolog, naturally occurring allele, or mutant thereof. Polypeptides of the invention also encompass those polypeptides that are encoded by any Cry2Ax or Cry2Ax-derived nucleic acid of the invention. In one embodiment, polypeptides that have at least one Cry2Ax functional activity (e.g., insecticidal activity) and are at least 85%, 90%, 95%, 97%, 98%, or 99% identical to the polypeptide sequence of any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, or variants thereof. In another embodiment, polypeptides are encompassed that have at least one Cry2Ax functional activity (e.g., insecticidal activity), are at least 25, 50, 75, 100, 125, 150, 175, 200, 225, 250, 275, 300, 325, 350, 375, 400, 425, 450, 475, 500, 525, 550, 575, 600, or 625 contiguous amino acids in length, and are encoded by a polynucleotide that hybridizes under stringent conditions to the nucleic acid that encodes any of SEQ ID NOS: 2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, or a variant thereof. Methods of production of the polypeptides of the invention, e.g., by recombinant means, are also provided. Compositions comprising one or more polypeptides of the invention are also encompassed.

The present invention also relates to the nucleic acid molecules of Cry2Ax (SEQ ID NO:1) and Cry2Ax-derived nucleic acid molecules (SEQ ID NOS:3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259). Also encompassed by the present invention are fragments and analogs which encode polypeptides that are at least partially functionally active, i.e., they are capable of displaying one or more known functional activities associated with a wild type Cry2Ax polypeptide. In one embodiment, the invention encompasses an isolated nucleic acid molecule that comprises a nucleotide sequence i) which is at least 70%, 75%, 80%, 85%, 90%, 95%, 97%, 98%, or 99% identical to the nucleotide sequence of any of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259; ii) that hybridizes with a nucleic acid probe consisting of the nucleotide sequence of any of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, or a complement thereof under stringent conditions; and/or iii) that comprises a nucleic acid molecule that encodes a polypeptide comprising the amino acid sequence of any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260. Vectors comprising nucleic acids of the invention are also encompassed. Cells or plants comprising the vectors of the invention are also encompassed.

The present invention also relates to transgenic plants expressing a nucleic acid and/or polypeptide of the invention. The transgenic plants can express the transgene in any way known in the art including, but not limited to, constitutive expression, developmentally regulated expression, tissue specific expression, etc. Seed obtained from a transgenic plant of the invention is also encompassed.

4. BRIEF DESCRIPTION OF THE FIGURES

FIG. 1 shows insecticidal activity of DNA clones from the second round of shuffling. Each clone was expressed in *N. benthamiana* leaves using forced infiltration. Each leaf disk was fed to a single $3^{rd}$ instar *H. zea* larvae. Following a 24-hour incubation period, the feeding activity was determined by visual observation and expressed as an approximate fraction of leaf area remaining. The y-axis is the percent of the leaf disk remaining after exposure to the insect. The x-axis is the clone expressed in the leaf disk. Several clones shoed increased insecticidal activity such as 7K (D_S01000779) (SEQ ID NO:10), 15K (D_S00999080) (SEQ ID NO:12), 16K (D_S01000269) (SEQ ID NO:14), 16R (D_S01037143) (SEQ ID NO:16), and 473R (D_S01037677) (SEQ ID NO:18).

Figure 2:
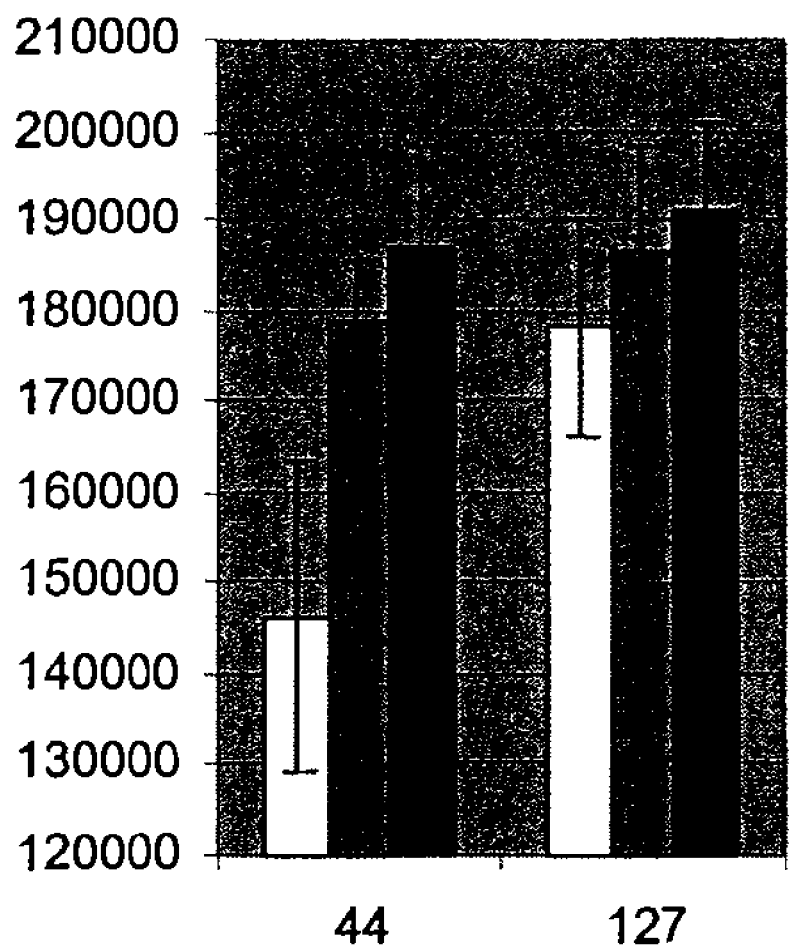

FIG. 2 shows insecticidal activity of first round shuffled clone 44 (D_S00503970) and third round shuffled clone D_S01764701. Each clone was expressed in *N. benthamiana* leaves using forced infiltration. Each leaf disk was fed to a single $3^{rd}$ instar *H. zea* larva. Following a 24-hour incubation period, the feeding activity was determined by video capture of the leaf disk. The y-axis is the number of pixels present in the captured leaf disk image. The x-axis is the clone expressed in the leaf disk. Results are shown for the average of three experiments. For each experiment at least eight leaf disks were tested for each clone.

Figure 3:
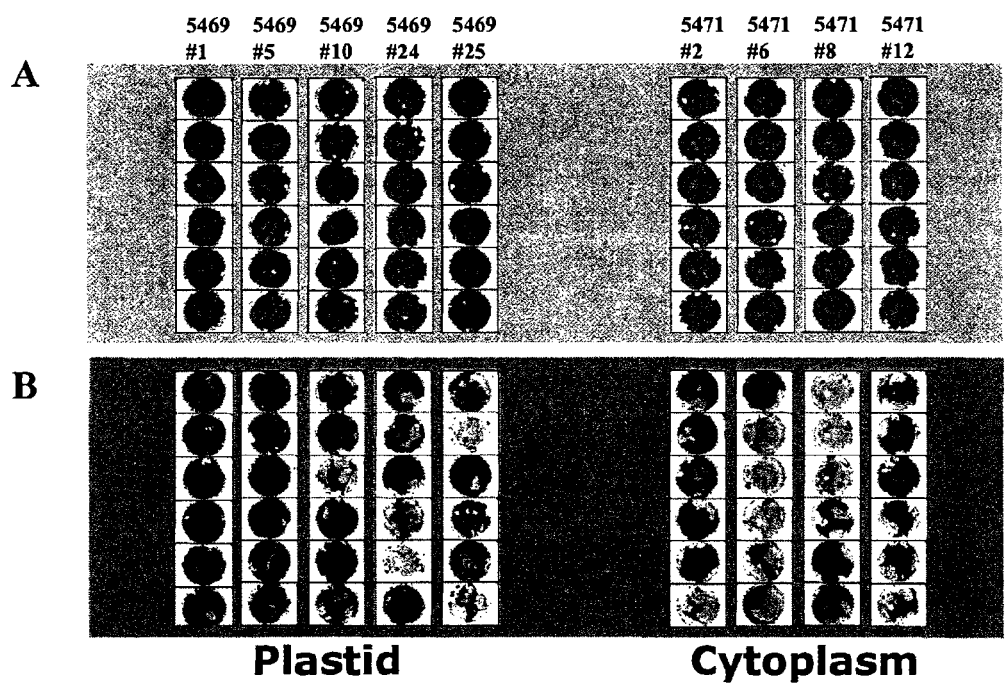

FIGS. 3A-3B show efficacy results for transgenic tobacco plants expressing first round shuffled clone 44 in the plastid compartment (left panels) or in the cytoplasm (right panels). The efficacy of (A) *H. zea* or (B) *S. exigua* inhibition was determined after incubation of the leaves with the worms for 24 hours. The amount of leaf remaining was observed with video capture equipment for actual calculation of relative leaf area remaining (number of pixels). Each transgenic plant had six leaf disks taken for analysis. Because twenty five transgenic plants were made using each transgene construct, the numbers distinguish different plants using a particular construct.

FIGS. 4A-4B show transgene expression levels in the first round shuffled clone 44-expressing transgenic plants. This shuffled Cry2-derived polypeptide was expressed in (A) the plastidic or (B) cytoplasmic subcellular compartments by transformation with pMAXY5469 or pMAXY5471, respectively. Western blot analysis was performed on transgenic plant extracts using a polyclonal antibody directed to the toxin region of the first round shuffled clone 44 polypeptide. Negative controls were extracts taken from an untransformed plant. Positive controls were either 20 ng or 40 ng of purified Cry2Ax toxin. The molecular weight of the positive control Cry2Ax differs from that of the Cry2Ax-derived polypeptide in the plant extracts because the former is trypsin activated and the latter is pro-toxin.

5. DETAILED DESCRIPTION

The present invention provides insecticidal polypeptides related to *Bacillus* Cry2 polypeptides. Nucleic acid molecules encoding the polypeptides of the invention are also provided. Methods for using the polypeptides and nucleic acids of the invention to enhance resistance of plants to insect predation are encompassed.

5.1 Polypeptides of the Invention

The present invention relates to a novel Cry2 polypeptide, Cry2Ax (SEQ ID NO:2), isolated from *Bacillus thuringiensis*. Also encompassed by the present invention are Cry2Ax-derived polypeptides (SEQ ID NOS: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260). Polypeptides of the invention also encompass those polypeptides that are encoded by any Cry2Ax or Cry2Ax-derived nucleic acid of the invention (see Section 5.2).

In addition to the polypeptide sequence of Cry2Ax and Cry2Ax-derived polypeptides, it will be appreciated that polypeptides of the invention also encompass variants thereof, including, but not limited to, any substantially similar sequence, any fragment, analog, homolog, naturally occurring allele, or mutant thereof. Variants encompassed by the invention are polypeptides that are at least partially functionally active, i.e., they are capable of displaying one or more known functional activities associated with a wild type Cry2Ax polypeptide. Such functional activities include, but are not limited to, biological activities, such as insecticidal activity; antigenicity, i.e., an ability to bind or compete with Cry2Ax for binding to an anti-Cry2Ax antibody; immunogenicity, i.e., an ability to generate antibody which binds to a Cry2Ax polypeptide. In some embodiments, the variants have at least one functional activity that is substantially similar to its parent polypeptide (e.g., a variant of Cry2Ax will have at least one functional activity that is substantially similar to Cry2Ax). As used herein, the functional activity of the variant will be considered "substantially similar" to its parent polypeptide if it is within one standard deviation of the parent.

In one embodiment, polypeptides that have at least one Cry2Ax functional activity (e.g., insecticidal activity) and are at least 85%, 90%, 95%, 97%, 98%, or 99% identical to the polypeptide sequence of any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260 are encompassed by the invention. Such polypeptides of the invention contain at least 1, at least 5, at least 10, at least 20, at least 30, or all 40 amino acid residues from the group consisting of $H_2$, $S_7$, $Q_{27}$, $Q_{35}$, $E_{36}$, $K_{43}$ $D_{44}$, $N_{45}$, $D_{51}$, $A_{58}$, $V_{69}$, $R_{78}$, $N_{79}$, $K_{99}$, $T_{118}$, $V_{124}$, $E_{125}$, $R_{129}$, $N_{138}$, $R_{139}$, $A_{141}$, $T_{162}$, $Q_{165}$, $M_{166}$, $L_{183}$, $I_{192}$, $H_{211}$, $R_{213}$, $R_{217}$, $D_{218}$, $V_{324}$, $I_{386}$, $T_{399}$, $S_{405}$, $Q_{445}$, $I_{551}$, $S_{587}$, $I_{591}$, $L_{610}$, and $L_{631}$. The subscript indicates the amino acid residue position corresponding to the position in SEQ ID NO:2 upon optimal alignment of the polypeptide sequence with SEQ ID NO:2. With respect to an amino acid sequence that is optimally aligned with a reference sequence, an amino acid "corresponds" to the position in the reference sequence with which the residue is paired in the alignment.

As used herein, where a sequence is defined as being "at least X % identical" to a reference sequence, e.g., "a polypeptide at least 95% identical to SEQ ID NO:2," it is to be understood that "X % identical" refers to absolute percent identity, unless otherwise indicated. The term "absolute percent identity" refers to a percentage of sequence identity determined by scoring identical amino acids or nucleic acids as one and any substitution as zero, regardless of the similarity of mismatched amino acids or nucleic acids. In a typical sequence alignment the "absolute percent identity" of two sequences is presented as a percentage of amino acid or nucleic acid "identities." In cases where an optimal alignment of two sequences requires the insertion of a gap in one or both of the sequences, an amino acid residue in one sequence that aligns with a gap in the other sequence is counted as a mismatch for purposes of determining percent identity. Gaps can be internal or external, i.e., a truncation. Absolute percent identity can be readily determined using, for example, the Clustal W program, version 1.8, June 1999, using default parameters (Thompson et al., 1994, *Nucleic Acids Research* 22: 4673-4680).

In another embodiment, fragments of Cry2Ax and Cry2Ax-derived polypeptides are encompassed by the invention. Polypeptides are encompassed that have at least one Cry2Ax functional activity (e.g., insecticidal activity), are at least 25, 50, 75, 100, 125, 150, 175, 200, 225, 250, 275, 300, 325, 350, 375, 400, 425, 450, 475, 500, 525, 550, 575, 600, or 625 contiguous amino acids in length of any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, and are encoded by a polynucleotide that hybridizes under stringent conditions to the nucleic acid that encodes any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260. In embodiments where the fragment of the invention encompasses any of the amino acid residues that correspond to amino acid residues 2, 7, 27, 35, 36, 43, 44, 45, 51, 58, 69, 78, 79, 99, 118, 124, 125, 129, 138, 139, 141, 161, 165, 166, 183, 192, 211, 213, 217, 218, 324, 386, 399, 405, 445, 551, 587, 591, 610, 631 of SEQ ID NO:2, such polypeptides of the invention contain at least 1, at least 5, at least 10, at least 20, at least 30, or all 40 amino acid residues from the group consisting of $H_2$, $S_7$, $Q_{27}$, $Q_{35}$, $E_{36}$, $K_{43}$, $D_{44}$, $N_{45}$, $D_{51}$, $A_{58}$, $V_{69}$, $R_{78}$, $N_{79}$, $K_{99}$, $T_{118}$, $V_{124}$, $E_{125}$, $R_{129}$, $N_{138}$, $R_{139}$, $A_{141}$, $T_{162}$, $Q_{165}$, $M_{166}$, $L_{183}$, $I_{192}$, $H_{211}$, $R_{213}$, $R_{217}$, $D_{218}$, $V_{324}$, $I_{386}$, $T_{399}$, $S_{405}$, $Q_{445}$, $I_{551}$, $S_{587}$, $I_{591}$, $L_{610}$, and $L_{631}$.

In a specific embodiment, a fragment of the invention corresponds to the length of the processed pro-toxin. There is a 5-6 kDa difference in molecular weight between full length pro-toxin Cry2 and the processed Cry2 toxin. This is the result of ~40 amino acids being cleaved from the pro-toxin Cry2 polypeptide (Rukmini et al., 2000, *Biochimie* 82:109-116; Aronson et al., 1993, *Mol. Microbiol.* 7:489-496; Morse et al., 2001, *Structure* 9:409-17). Polypeptides that correspond to this processed Cry2 fragment can be provided in the methods of the present invention directly to circumvent the need for pro-toxin processing.

In another specific embodiment, a fragment of the invention corresponds to a Cry2 domain. Cry2 polypeptides have three domains including i) domain I which is involved in insertion into the insect apical midgut membrane and affects ion channel function, ii) domain II which is involved in receptor binding on the insect midgut epithelial cell membrane, and iii) domain III which is involved in ion channel function, receptor binding, and insertion into the membrane (Dean et al., 1996, *Gene* 179:111-117; Schnepf et al., 1998, *Microbiol. Molec. Biol. Rev.* 62:775-806).

In another embodiment, analog polypeptides are encompassed by the invention. Analog polypeptides may possess residues that have been modified, i.e., by the covalent attachment of any type of molecule to the Cry2Ax or Cry2Ax-derived polypeptides. For example, but not by way of limitation, an analog polypeptide of the invention may be modified, e.g., by glycosylation, acetylation, pegylation, phosphorylation, amidation, derivatization by known protecting/blocking groups, proteolytic cleavage, linkage to a cellular ligand or other protein, etc. An analog polypeptide of the invention may be modified by chemical modifications using techniques known to those of skill in the art, including, but not limited to specific chemical cleavage, acetylation, formylation, metabolic synthesis of tunicamycin, etc. Furthermore, an analog of a polypeptide of the invention may contain one or more non-classical amino acids.

Methods of production of the polypeptides of the invention, e.g., by recombinant means, are also provided (see Section 5.6).

Compositions comprising one or more polypeptides of the invention are also encompassed. The compositions of the invention can further comprise additional agents including, but not limited to, spreader-sticker adjuvants, stabilizing agents, other insecticidal additives, diluents, agents that optimize the rheological properties or stability of the composition, such as, for example, surfactants, emulsifiers, dispersants, and/or polymers.

5.2 Nucleic Acids of the Invention

The present invention also relates to the nucleic acid molecules of Cry2Ax (SEQ ID NO:1) and Cry2Ax-derived nucleic acid molecules (SEQ ID NOS:3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259). Nucleic acid molecules of the invention also encompass those nucleic acid molecules that encode any Cry2Ax or Cry2Ax-derived polypeptide of the invention (see Section 5.1).

In addition to the nucleic acid molecule of Cry2Ax and Cry2Ax-derived nucleic acid molecules, it will be appreciated that nucleic acids of the invention also encompass variants thereof, including, but not limited to any substantially similar sequence, any fragment, homolog, naturally occurring allele, or mutant thereof. Variant nucleic acid molecules encompassed by the present invention encode polypeptides that are at least partially functionally active, i.e., they are capable of displaying one or more known functional activities associated with a wild type Cry2Ax polypeptide. Such functional activities include, but are not limited to, biological activities, such as insecticidal activity; antigenicity, i.e., an ability to bind or compete with Cry2Ax for binding to an anti-Cry2Ax antibody; immunogenicity, i.e., an ability to generate antibody which binds to a Cry2Ax polypeptide. In some embodiments, the variants have at least one functional activity that is substantially similar to its parent nucleic acid molecule (e.g., a variant of a Cry2Ax nucleic acid molecule will encode a polypeptide that has at least one functional activity that is substantially similar to the polypeptide encoded for by the Cry2Ax nucleic acids molecule). As used herein, the functional activity of the variant will be considered "substantially similar" to its parent polypeptide if it is within one standard deviation of the parent.

In one embodiment, nucleic acid molecules that are at least 70%, 75%, 80%, 85%, 90%, 95%, 97%, 98%, or 99% identical to any of the nucleic acid molecules of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259 are encompassed by the invention. Such nucleic acid molecules of the invention encode polypeptides that contain at least one, at least 5, at least 10, at least 20, at least 30, or all 40 amino acid residues from the group consisting of $H_2$, $S_7$, $Q_{27}$, $Q_{35}$, $E_{36}$, $K_{43}$, $D_{44}$, $N_{45}$, $D_{51}$, $A_{58}$, $V_{69}$, $R_{78}$, $N_{79}$, $K_{99}$, $T_{118}$, $V_{124}$, $E_{125}$, $R_{129}$, $N_{138}$, $R_{139}$, $A_{141}$, $T_{162}$, $Q_{165}$, $M_{166}$, $L_{183}$, $I_{192}$, $H_{211}$, $R_{213}$, $R_{217}$, $D_{218}$, $V_{324}$, $I_{386}$, $T_{399}$, $S_{405}$, $Q_{445}$, $I_{551}$, $S_{587}$, $I_{591}$, $L_{610}$, and $L_{631}$.

To determine the percent identity of two nucleic acid molecules, the sequences are aligned for optimal comparison purposes (e.g., gaps can be introduced in the sequence of a first nucleic acid molecule for optimal alignment with a second or nucleic acid molecule). The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences (i.e., % identity=number of identical overlapping positions/total number of positions×100%). In one embodiment, the two sequences are the same length.

The determination of percent identity between two sequences can also be accomplished using a mathematical algorithm. A non-limiting example of a mathematical algorithm utilized for the comparison of two sequences is the algorithm of Karlin and Altschul (Karlin and Altschul, 1990, *Proc. Natl. Acad. Sci.* 87:2264-2268, modified as in Karlin and Altschul, 1993, *Proc. Natl. Acad. Sci.* 90:5873-5877). Such an algorithm is incorporated into the NBLAST and XBLAST programs (Altschul et al., 1990, *J. Mol. Biol.* 215: 403 and Altschul et al., 1997, *Nucleic Acid Res.* 25:3389-3402). Software for performing BLAST analyses is publicly available, e.g., through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, 1989, PNAS, 89:10915).

The Clustal V method of alignment can also be used to determine percent identity (Higgins and Sharp, 1989, CABIOS. 5:151-153) and found in the Megalign program of the LASERGENE bioinformatics computing suite (DNASTAR Inc., Madison, Wis.). The "default parameters" are the parameters pre-set by the manufacturer of the program and for multiple alignments they correspond to GAP PENALTY=10 and GAP LENGTH PENALTY=10, while for pairwise alignments they are KTUPLE 1, GAP PENALTY=3, WINDOW=5 and DIAGONALS SAVED=5. After alignment of the sequences, using the Clustal V program, it is possible to obtain a "percent identity" by viewing the "sequence distances" table on the same program.

The percent identity between two sequences can be determined using techniques similar to those described above, with or without allowing gaps. In calculating percent identity, typically only exact matches are counted.

In another embodiment, fragments of Cry2Ax and Cry2Ax-derived nucleic acid molecules are encompassed by the invention. Nucleic acid molecules are encompassed that have at least one Cry2Ax functional activity (e.g., insecticidal activity), are at least 100, 250, 500, 750, 1000, 1500, or 1800 contiguous nucleotides in length of any of SEQ ID NOS: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, and/or hybridize under stringent conditions to the nucleic acid molecule that encodes any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260. In embodiments where the nucleic acid fragment of the invention encodes a polypeptide that encompasses any of the amino acid residues that correspond to amino acid residues 2, 7, 27, 35, 36, 43, 44, 45, 51, 58, 69, 78, 79, 99, 118, 124, 125, 129, 138, 139, 141, 161, 165, 166, 183, 192, 211, 213, 217, 218, 324, 386, 399, 405, 445, 551, 587, 591, 610, 631 of SEQ ID NO:2, such nucleic acids molecules of the invention contain coding sequences for at least 1, at least 5, at least 10, at least 20, at least 30, or all 40 amino acid residues from the group consisting of $H_2$, $S_7$, $Q_{27}$, $Q_{35}$, $E_{36}$, $K_{43}$, $D_{44}$, $N_{45}$, $D_{51}$, $A_{58}$, $V_{69}$, $R_{78}$, $N_{79}$, $K_{99}$, $T_{118}$, $V_{124}$, $E_{125}$, $R_{129}$, $N_{138}$, $R_{139}$, $A_{141}$, $T_{162}$, $Q_{165}$, $M_{166}$, $L_{183}$, $I_{192}$, $H_{211}$, $R_{213}$, $R_{217}$, $D_{218}$, $V_{324}$, $I_{386}$, $T_{399}$, $S_{405}$, $Q_{445}$, $I_{551}$, $S_{587}$, $I_{591}$, $L_{610}$, and $L_{631}$.

In a specific embodiment, a fragment of the invention corresponds to the length of nucleic acid that encodes the processed pro-toxin. There is a 5-6 kDa difference in molecular weight between full length pro-toxin Cry2 and the processed Cry2 toxin. This is the result of ~40 amino acids being cleaved from the pro-toxin Cry2 polypeptide (Rukmini et al., 2000, *Biochimie* 82:109-116; Aronson et al., 1993, *Mol. Microbiol.* 7:489-496; Morse et al., 2001, *Structure* 9:409-17).

In another specific embodiment, a fragment of the invention encodes a polypeptide that corresponds to a Cry2 domain.

In another embodiment, a nucleic acid molecule that hybridizes under stringent conditions to any one of SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259 is encompassed by the invention. Such nucleic acid molecules of the invention encode polypeptides that contain at least 1, at least 5, at least 10, at least 20, at least 30, or all 40 amino acid residues from the group consisting of $H_2$, $S_7$, $Q_{27}$, $Q_{35}$, $E_{36}$, $K_{43}$, $D_{44}$, $N_{45}$, $D_{51}$, $A_{58}$, $V_{69}$, $R_{78}$, $N_{79}$, $K_{99}$, $T_{118}$, $V_{124}$, $E_{125}$, $R_{129}$, $N_{138}$, $R_{139}$, $A_{141}$, $T_{162}$, $Q_{165}$, $M_{166}$, $L_{183}$, $I_{192}$, $H_{211}$, $R_{213}$, $R_{217}$, $D_{218}$, $V_{324}$, $I_{386}$, $T_{399}$, $S_{405}$, $Q_{445}$, $I_{551}$, $S_{587}$, $I_{591}$, $L_{610}$, and $L_{631}$.

The phrase "stringent conditions" refers to hybridization conditions under which a nucleic acid will hybridize to its target nucleic acid, typically in a complex mixture of nucleic acid, but to essentially no other nucleic acids. Stringent conditions are sequence-dependent and will be different in different circumstances. Longer nucleic acids hybridize specifically at higher temperatures. Extensive guides to the hybridization of nucleic acids can be found in the art (e.g., Tijssen, *Techniques in Biochemistry and Molecular Biology—Hybridization with Nucleic Probes*, "Overview of principles of hybridization and the strategy of nucleic acid assays" (1993)). Generally, highly stringent conditions are selected to be about 5-10° C. lower than the thermal melting point ($T_m$) for the specific nucleic acid at a defined ionic strength pH. Low stringency conditions are generally selected to be about 15-30° C. below the $T_m$. The $T_m$ is the temperature (under defined ionic strength, pH, and nucleic acid concentration) at which 50% of the probes complementary to the target hybridize to the target nucleic acid at equilibrium (as the target nucleic acids are present in excess, at $T_m$, 50% of the probes are occupied at equilibrium). Hybridization conditions are typically those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. For selective or specific hybridization, a positive signal is at least two times background, and preferably 10 times background hybridization. In one embodiment, stringent conditions include at least one wash (usually 2) in 0.2×SSC at a temperature of at least about 50° C., usually about 55° C., or sometimes 60° C. or 65° C., for 20 minutes, or substantially equivalent conditions. In a specific embodiment, the nucleic acid molecule of the invention specifically hybridizes following at least one wash in 0.2×SSC at 55° C. for 20 minutes to a polynucleotide encoding the polypeptide of any of SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260. In another embodiment, stringent conditions include hybridization in 6× sodium chloride/sodium citrate (SSC) at about 45° C. followed by one or more washes in 0.2×SSC, 0.1% SDS at 50-65° C.

The phrase "specifically hybridizes" refers to the binding, duplexing, or hybridizing of a molecule only to a particular nucleotide sequence under stringent hybridization conditions when that sequence is present in a complex mixture (e.g., total cellular or library DNA or RNA).

Vectors comprising nucleic acids of the invention are also encompassed. Cells or plants comprising the vectors of the invention are also encompassed.

The term "nucleic acid" or "nucleic acid molecule" herein refer to a single or double-stranded polymer of deoxyribonucleotide or ribonucleotide bases read from the 5' to the 3' end. It includes chromosomal DNA, self-replicating plasmids and DNA or RNA that performs a primarily structural role. The term "encoding" refers to a polynucleotide sequence encoding one or more amino acids. The term does not require a start or stop codon. An amino acid sequence can be encoded in any one of six different reading frames provided by a polynucleotide sequence and its complement.

Table 1 discloses Cry2Ax and Cry2Ax-derived sequences and the corresponding sequence identity number.

5.3 Cry2Ax-Derived Sequences

Cry2Ax-derived polypeptides and nucleic acids of the invention can be created by introducing one or more nucleotide substitutions, additions and/or deletions into the nucleotide sequence of Cry2Ax or related nucleic acids, such that one or more amino acid substitutions, additions and/or deletions are introduced into the encoded protein. Generally, Cry2Ax-derived sequences are created in order to accentuate a desirable characteristic or reduce an undesirable characteristic of a Cry2Ax polypeptide. In one embodiment, Cry2Ax-derived polypeptides have improved insecticidal activity over Cry2Ax including, but not limited to, greater potency and/or increased insect pest range. In another embodiment, Cry2Ax-derived polypeptides are expressed better than Cry2Ax including, but not limited to, increased half life, less susceptible to degradation, and/or more efficient transcription or translation.

In one embodiment, a Cry2Ax (SEQ ID NO:1) nucleic acid molecule is used as a template to create Cry2Ax-derived nucleotides. In another embodiment, a Cry2Ax related nucleic acid is used as a template to create Cry2Ax-derived nucleotides. In a specific embodiment, Cry2Ab* is used as a template. Cry2Ab* has two amino acid changes relative to wild type Cry2Ab (K to R at position 36 and M to T at position 241 of GenBank Accession No. M23724). In another specific embodiment, clones isolated from one round of alteration can be used as template for further rounds of alteration (e.g., clones 38, 44, and 473R; see Sections 6.2 and 6.4).

Sequence alterations can be introduced by standard techniques such as directed molecular evolution techniques e.g., DNA shuffling methods (see e.g., Christians et al., 1999, *Nature Biotechnology* 17:259-264; Crameri et al., 1998, *Nature,* 391:288-291; Crameri, et al., 1997, *Nature Biotechnology* 15:436-438; Crameri et al., 1996, *Nature Biotechnology* 14:315-319; Stemmer, 1994, *Nature* 370:389-391; Stemmer et al., 1994, *Proc. Natl. Acad. Sci.,* 91:10747-10751; U.S. Pat. Nos. 5,605,793; 6,117,679; 6,132,970; 5,939,250; 5,965,408; 6,171,820; International Publication Nos. WO 95/22625; WO 97/0078; WO 97/35966; WO 98/27230; WO 00/42651; and WO 01/75767); site directed mutagenesis (see e.g., Kunkel, 1985, *Proc. Natl. Acad. Sci.,* 82:488-492; Oliphant et al., 1986, *Gene* 44:177-183); oligonucleotide-directed mutagenesis (see e.g., Reidhaar-Olson et al., 1988, *Science* 241:53-57); chemical mutagenesis (see e.g., Eckert et al., 1987, *Mutat. Res.* 178: 1-10); error prone PCR (see e.g., Caldwell & Joyce, 1992, *PCR Methods Applic.* 2:28-33); and cassette mutagenesis (see e.g., Arkin et al., *Proc. Natl. Acad. Sci.,* 1992, 89:7871-7815); (see generally, e.g., Arnold, 1993, *Curr. Opinion Biotechnol.* 4:450-455; Ling et al., 1997, *Anal. Biochem.,* 254(2):157-78; Dale et al., 1996, *Methods Mol. Biol.* 57:369-74; Smith, 1985, *Ann. Rev. Genet.* 19:423-462; Botstein et al., 1985, *Science,* 229:1193-1201; Carter, 1986, *Biochem. J.* 237:1-7; Kramer et al., 1984, *Cell* 38:879-887; Wells et al., 1985, *Gene* 34:315-323; Minshull et al., 1999, *Current Opinion in Chemical Biology* 3:284-290).

In one embodiment, DNA shuffling is used to create Cry2Ax-derived nucleotides. DNA shuffling can be accomplished in vitro, in vivo, in silico, or a combination thereof. In silico methods of recombination can be effected in which genetic algorithms are used in a computer to recombine sequence strings which correspond to homologous (or even non-homologous) nucleic acids. The resulting recombined sequence strings are optionally converted into nucleic acids by synthesis of nucleic acids which correspond to the recombined sequences, e.g., in concert with oligonucleotide synthesis gene reassembly techniques. This approach can generate random, partially random or designed alterations. Many details regarding in silico recombination, including the use of genetic algorithms, genetic operators and the like in computer systems, combined with generation of corresponding nucleic acids as well as combinations of designed nucleic acids (e.g., based on cross-over site selection) as well as designed, pseudo-random or random recombination methods are described in the art (see e.g., International Publication Nos. WO 00/42560 and WO 00/42559).

In another embodiment, targeted mutagenesis is used to create Cry2Ax-derived nucleotides by choosing particular nucleotide sequences or positions of the Cry2Ax or related nucleic acid for alteration. Such targeted mutations can be introduced at any position in the nucleic acid. For example, one can make nucleotide substitutions leading to amino acid substitutions at "non-essential" or "essential" amino acid residues. A "non-essential" amino acid residue is a residue that can be altered from the wild-type sequence without altering the biological activity, whereas an "essential" amino acid residue is required for at least one biological activity of the polypeptide. For example, amino acid residues that are not conserved or only semi-conserved among homologs of various species may be non-essential for activity. Alternatively, amino acid residues that are conserved among the homologs of various species may be essential for activity.

Such targeted mutations can be conservative or non-conservative. A "non-conservative amino acid substitution" is one in which the amino acid residue is replaced with an amino acid residue having a dissimilar side chain. Families of amino acid residues having similar side chains have been defined in the art. These families include amino acids with basic side chains (e.g., lysine, arginine, histidine), acidic side chains (e.g., aspartic acid, glutamic acid, asparagine, glutamine), uncharged polar side chains (e.g., glycine, serine, threonine, tyrosine, cysteine), nonpolar side chains (e.g., alanine, valine, leucine, isoleucine, proline, phenylalanine, methionine, tryptophan), β-branched side chains (e.g., threonine, valine, isoleucine) and aromatic side chains (e.g., tyrosine, phenylalanine, tryptophan, histidine).

Alternatively or in addition to non-conservative amino acid residue substitutions, such targeted mutations can be conservative. A "conservative amino acid substitution" is one in which the amino acid residue is replaced with an amino acid residue having a similar side chain. Following mutagenesis, the encoded protein can be expressed recombinantly and the activity of the protein can be determined.

In another embodiment, random mutagenesis is used to create Cry2Ax-derived nucleotides. Mutations can be introduced randomly along all or part of the coding sequence (e.g., by saturation mutagenesis). In certain embodiments, nucleotide sequences encoding other related polypeptides that have similar domains, structural motifs, active sites, or that align with a portion of the Cry2Ax of the invention with mismatches or imperfect matches, can be used in the mutagenesis process to generate diversity of sequences.

It should be understood that for each mutagenesis step in some of the techniques mentioned above, a number of iterative cycles of any or all of the steps may be performed to optimize the diversity of sequences. The above-described methods can be used in combination in any desired order. In many instances, the methods result in a pool of altered nucleic acid sequences or a pool of recombinant host cells comprising altered nucleic acid sequences. The altered nucleic acid sequences or host cells expressing an altered nucleic acid sequence with the desired characteristics can be identified by screening with one or more assays known in the art. The assays may be carried out under conditions that select for polypeptides possessing the desired physical or chemical characteristics. The alterations in the nucleic acid sequence can be determined by sequencing the nucleic acid molecule encoding the altered polypeptide in the clones.

Additionally, Cry2Ax and Cry2Ax-derived nucleic acid molecules can be codon optimized, either wholly or in part. Because any one amino acid (except for methionine) is encoded by a number of codons (Table 2), the sequence of the nucleic acid molecule may be changed without changing the encoded amino acid. Codon optimization is when one or more codons are altered at the nucleic acid level such that the amino acids are not changed but expression in a particular host organism is increased. Those having ordinary skill in the art will recognize that tables and other references providing preference information for a wide range of organisms are available in the art.

5.4 Methods of Assaying Insecticidal Activity

As used herein, the term "insecticidal activity" refers to the ability of a polypeptide to decrease or inhibit insect feeding and/or to increase insect mortality upon ingestion of the polypeptide. Although any insect may be effected, preferably insects of the Lepidoptera and Diptera orders of insects are affected.

A variety of assays can be used to determine whether a particular polypeptide of the invention has insecticidal activity and, if so, to what degree. Generally, an insect pest is provided a polypeptide of the invention in any form that can be ingested. The reaction of the insect pest to ingestion of the polypeptide of the invention is observed (e.g., for about one to three days). A decrease or inhibition of feeding and/or an increase in insect pest mortality after ingestion of the polypeptide of the invention are indicators of insecticidal activity. A polypeptide of the invention with unknown insecticidal activity should be compared to a positive and/or negative control to assess more accurately the outcome of the assay.

In one embodiment, a polypeptide of the invention is purified (either in soluble form or in crystal form) and added to the insect diet.

In another embodiment, a polypeptide of the invention is expressed in a recombinant microbe (e.g., *E. coli*). The recombinant microbe is fed directly to the insect pests (see Moellenbeck et al., 2001, *Nat. Biotechnol.* 19:668).

In another embodiment, the polypeptide of the invention is expressed in a plant and the plant is fed to the insect pest. Following the incubation period, the feeding activity of the insect pest can be determined by visual observation (e.g., of approximate fraction of leaf area remaining) or video capture (e.g., number of pixels in a leaf area remaining) of the plant parts that would normally have been eaten by the insect pest. In a specific embodiment, expression of the polypeptide of the invention in the plant is transient. In such embodiments, a nucleic acid encoding a polypeptide of the invention is cloned into a plant expression vector and transfected into *Agrobacterium tumefaciens*. The transformed bacteria is co-cultivated with a leaf from *N. benthamiana* and, using forced infiltration, the leaf expresses the polypeptide of the invention. However, expression of the polypeptide is variable between leaf co-cultures. In another specific embodiment, expression of the polypeptide of the invention in the plant is stable. In such embodiments, a transgenic plant is made that expresses a polypeptide of the invention.

In another embodiment, insecticidal activity of a polypeptide of the invention can be assayed by measuring cell death and/or cell growth using cultured cells. Such assays typically involve the use of cultured insect cells that are susceptible to the particular toxin being screened, or cells that express a receptor for the particular toxin, either naturally or as a result of expression of a heterologous gene. Thus, in addition to insect cells, mammalian, bacterial, and yeast cells are among those cells useful in the in vitro assays. In vitro bioassays which measure toxicity against cultured cells are described in the art (e.g., Johnson, 1994, *J. Invertebr. Pathol.* 63:123-129).

In another embodiment, insecticidal activity of a polypeptide of the invention can be assayed by measuring pore formation in target insect-derived midgut epithelial membrane vesicles (Juttner and Ebel, 1998, *Biochim. Biophys. Acta* 1370:51-63; English et al., 1991, *Insect Biochem.* 21:177-184). Such an assay may constitute toxin conditional release of a ligand activated substrate from the lumen of the membrane vesicles. This requires that the ligand be on the outside of the vesicle. Alternatively the reverse scenario may be utilized whereby the ligand is in the vesicle lumen and the ready to be activated substrate is located on the outside of the vesicle. The higher the toxin activity the greater the number or size of pores formed.

5.5 Methods of Enhancing Insect Resistance in Plants

The present invention provides methods of enhancing plant resistance to insect pests including, but not limited to, members of the *Helicoverpa* ssp. (e.g., *Helicoverpa Zea*) and/or *Spodoptera* ssp. (e.g., *Spodopter exigua*) through the use of Cry2 related insecticidal polypeptides. Any method known in the art can be used to cause the insect pests to ingest one or more polypeptides of the invention during the course of feeding on the plant. As such, the insect pest will ingest insecticidal amounts of the one or more polypeptides of the invention and may discontinue feeding on the plant. In some embodiments, the insect pest is killed by ingestion of the one or more polypeptides of the invention. In other embodiments, the insect pests are inhibited or discouraged from feeding on the plant without being killed.

In one embodiment, transgenic plants can be made to express one or more polypeptides of the invention (see generally Section 5.7 for methods of transgenic plant production). The transgenic plant may express the one or more polypeptides of the invention in all tissues (e.g., global expression). Alternatively, the one or more polypeptides of the invention may be expressed in only a subset of tissues (e.g., tissue specific expression), preferably those tissues consumed by the insect pest. Polypeptides of the invention can be expressed constitutively in the plant or be under the control of an inducible promoter.

In another embodiment, a composition comprising one or more polypeptides of the invention can be applied externally to a plant susceptible to the insect pests. External application of the composition includes direct application to the plant, either in whole or in part, and/or indirect application, e.g., to the environment surrounding the plant such as the soil. The composition can be applied by any method known in the art including, but not limited to, spraying, dusting, sprinkling, or the like. In general, the composition can be applied at any time during plant growth. One skilled in the art can use methods known in the art to determine empirically the optimal time for administration of the composition. Factors that affect optimal administration time include, but are not limited to, the type of susceptible plant, the type of insect pest, which one or more polypeptides of the invention are administered in the composition.

The composition comprising one or more polypeptides of the invention may be substantially purified polypeptides, a cell suspension, a cell pellet, a cell supernatant, a cell extract, or a spore-crystal complex of *Bacillus thuringiensis* cells (see generally Section 5.6 for recombinant polypeptide synthesis techniques). The composition comprising one or more polypeptides of the invention may be in the form of a solution, an emulsion, a suspension, or a powder. Liquid formulations may be aqueous or non-aqueous based and may be provided as foams, gels, suspensions, emulsifiable concentrates, or the like. The formulations may include agents in addition to the one or more polypeptides of the invention. For example, compositions may further comprise spreader-sticker adjuvants, stabilizing agents, other insecticidal additives, diluents, agents that optimize the rheological properties or stability of the composition, such as, for example, surfactants, emulsifiers, dispersants, or polymers.

In another embodiment, recombinant hosts that express one or more polypeptides of the invention are applied on or near a plant susceptible to attack by an insect pest. The recombinant hosts include, but are not limited to, microbial hosts and insect viruses that have been transformed with and express one or more nucleic acid molecules (and thus polypeptides) of the invention. In some embodiments, the recombinant host secretes the polypeptide of the invention into its surrounding environment so as to contact an insect pest. In other embodiments, the recombinant hosts colonize one or more plant tissues susceptible to insect infestation.

5.6 Recombinant Expression

Nucleic acid molecules and polypeptides of the invention can be expressed recombinantly using standard recombinant DNA and molecular cloning techniques that are well known in the art (e.g., Sambrook, Fritsch, and Maniatis, *Molecular Cloning: A Laboratory Manual*; Cold Spring Harbor Laboratory Press: Cold Spring Harbor, 1989). Additionally, recombinant DNA techniques may be used to create nucleic acid constructs suitable for use in making transgenic plants (see Section 5.7).

Accordingly, an aspect of the invention pertains to vectors, preferably expression vectors, comprising a nucleic acid molecule of the invention, or a variant thereof. As used herein, the term "vector" refers to a polynucleotide capable of transporting another nucleic acid to which it has been linked. One type of vector is a "plasmid", which refers to a circular double stranded DNA loop into which additional DNA segments can be introduced. Another type of vector is a viral vector, wherein additional DNA segments can be introduced into the viral genome.

Certain vectors are capable of autonomous replication in a host cell into which they are introduced (e.g., bacterial vectors having a bacterial origin of replication and episomal vectors). Other vectors (e.g., non-episomal vectors) are integrated into the genome of a host cell upon introduction into the host cell, and thereby are replicated along with the host genome. In general, expression vectors of utility in recombinant DNA techniques are often in the form of plasmids (vectors). However, the invention is intended to include such other forms of expression vectors, such as viral vectors (e.g., replication defective retroviruses).

The recombinant expression vectors of the invention comprise a nucleic acid molecule of the invention in a form suitable for expression of the nucleic acid molecule in a host cell. This means that the recombinant expression vectors include one or more regulatory sequences, selected on the basis of the host cells to be used for expression, which is operably associated with the polynucleotide to be expressed. Within a recombinant expression vector, "operably associated" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described in the art (e.g., Goeddel, *Gene Expression Technology: Methods in Enzymology,* 1990, Academic Press, San Diego, Calif.). Regulatory sequences include those which direct constitutive expression of a nucleotide sequence in many types of host cells and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, the area of the organism in which expression is desired, etc. The expression vectors of the invention can be introduced into host cells to thereby produce proteins or peptides, including fusion proteins or peptides, encoded by nucleic acids molecules as described herein.

In some embodiments, isolated nucleic acids which serve as promoter or enhancer elements can be introduced in the appropriate position (generally upstream) of a non-heterologous form of a polynucleotide of the present invention so as to up or down regulate expression of a polynucleotide of the present invention. For example, endogenous promoters can be altered in vivo by mutation, deletion, and/or substitution (see, U.S. Pat. No. 5,565,350; International Patent Application No. PCT/US93/03868), or isolated promoters can be introduced into a plant cell in the proper orientation and distance from a cognate gene of a polynucleotide of the present invention so as to control the expression of the gene. Gene expression can be modulated under conditions suitable for plant growth so as to alter the total concentration and/or alter the composition of the polypeptides of the present invention in plant cell. Thus, the present invention provides compositions, and methods for making heterologous promoters and/or enhancers operably linked to a native, endogenous (i.e., non-heterologous) form of a polynucleotide of the present invention.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added can be derived from, for example, the nopaline synthase or octopine synthase genes, or alternatively from another plant gene, or less preferably from any other eukaryotic gene.

The recombinant expression vectors of the invention can be designed for expression of a polypeptide of the invention in prokaryotic (e.g., Enterobacteriaceae, such as *Escherichia*; Bacillaceae; Rhizoboceae, such as *Rhizobium* and *Rhizobacter*; Spirillaceae, such as photobacterium; *Zymomonas; Serratia; Aeromonas; Vibrio; Desulfovibrio; Spirillum*; Lactobacillaceae; Pseudomonadaceae, such as *Pseudomonas* and *Acetobacter*; Azotobacteraceae and Nitrobacteraceae) or eukaryotic cells (e.g., insect cells using baculovirus expression vectors, yeast cells, plant cells, or mammalian cells) (see Goeddel, supra. For a discussion on suitable host cells). Alternatively, the recombinant expression vector can be transcribed and translated in vitro, for example using T7 promoter regulatory sequences and T7 polymerase.

Expression of proteins in prokaryotes is most often carried out in *E. coli* with vectors comprising constitutive or inducible promoters directing the expression of either fusion or non-fusion proteins. Fusion vectors add a number of amino acids to a protein encoded therein, usually to the amino terminus of the recombinant protein. Such fusion vectors typically serve at least three purposes: 1) to increase expression of the recombinant protein; 2) to increase the solubility of the recombinant protein; and/or 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

In another embodiment, the expression vector is a yeast expression vector. Examples of vectors for expression in yeast *S. cerevisiae* include pYepSec1 (Baldari et al., 1987, *EMBO J.* 6:229-234), pMFa (Kurjan and Herskowitz, 1982, *Cell* 30:933-943), pJRY88 (Schultz et al., 1987, *Gene* 54:113-123), pYES2 (Invitrogen Corp., San Diego, Calif.), and pPicZ (Invitrogen Corp., San Diego, Calif.).

Alternatively, the expression vector is a baculovirus expression vector. Baculovirus vectors available for expression of proteins in cultured insect cells (e.g., Sf 9 cells) include the pAc series (Smith et al., 1983, *Mol. Cell. Biol.* 3:2156-2165) and the pVL series (Lucklow and Summers, 1989, *Virology* 170:31-39).

In yet another embodiment, a nucleic acid of the invention is expressed in plant cells using a plant expression vector including, but not limited to, tobacco mosaic virus and potato virus expression vectors.

Other suitable expression systems for both prokaryotic and eukaryotic cells are known in the art (see, e.g., chapters 16 and 17 of Sambrook et al. 1990, *Molecular Cloning, A Laboratory Manual,* 2d Ed., Cold Spring Harbor Laboratory, Cold Spring Harbor, N.Y.).

A number of promoters can be used in the practice of the invention. The promoters can be selected based on the desired outcome. The nucleic acids can be combined with constitutive, tissue-specific, inducible, or other promoters for expression in the host organism.

A "tissue-specific promoter" may direct expression of nucleic acids of the present invention in a specific tissue, organ or cell type. Tissue-specific promoters can be inducible. Similarly, tissue-specific promoters may only promote transcription within a certain time frame or developmental stage within that tissue. Other tissue specific promoters may be active throughout the life cycle of a particular tissue. One of ordinary skill in the art will recognize that a tissue-specific promoter may drive expression of operably linked sequences in tissues other than the target tissue. Thus, as used herein, a tissue-specific promoter is one that drives expression preferentially in the target tissue or cell type, but may also lead to some expression in other tissues as well. A number of tissue-specific promoters can be used in the present invention. With the appropriate promoter, any organ can be targeted, such as shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit. For instance, promoters that direct expression of nucleic acids in leaves, roots or flowers are useful for enhancing resistance to pests that infect those organs. For expression of a polynucleotide of the present invention in the aerial vegetative organs of a plant, photosynthetic organ-specific promoters, such as the RBCS promoter (Khoudi et al., Gene 197:343, 1997), can be used. Root-specific expression of polynucleotides of the present invention can be achieved under the control of a root-specific promoter, such as, for example, the promoter from the ANR1 gene (Zhang and Forde, *Science,* 279:407, 1998). Other exemplary promoters include the root-specific glutamine synthetase gene from soybean (Hirel et al., 1992, *Plant Molecular Biology* 20:207-218) and the root-specific control element in the GRP 1.8 gene of French bean (Keller et al., 1991, *The Plant Cell* 3:1051-1061).

A "constitutive promoter" is defined as a promoter which will direct expression of a gene in all tissues and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumafaciens*, and other transcription initiation regions from various plant genes known to those of ordinary skill in the art. Such genes include for example, ACT11 from *Arabidopsis* (Huang et al. 1996, *Plant Mol. Biol.* 33:125-139), Cat3 from *Arabidopsis* (GenBank Accession No. U43147, Zhong et al., 1996, *Mol. Gen. Genet.* 251:196-203), the gene encoding stearoyl-acyl carrier protein desaturase from *Brassica napus* (Genbank Accession No. X74782, Solocombe et al. 1994, *Plant Physiol.* 104:1167-1176), GPc1 from maize (GenBank Accession No. X15596, Martinez et al., 1989, *J. Mol. Biol.* 208:551-565), and Gpc2 from maize (GenBank Accession No. U45855, Manjunath et al., 1997, *Plant Mol. Biol.* 33:97-112). Any strong, constitutive promoter, such as the CaMV 35S promoter, can be used for the expression of polynucleotides of the present invention throughout the plant.

The term "inducible promoter" refers to a promoter that is under precise environmental or developmental control. Examples of environmental conditions that may effect transcription by inducible promoters include anaerobic conditions, elevated temperature, the presence of light, or spraying with chemicals/hormones.

Suitable constitutive promoters for use in a plant host cell include, for example, the core promoter of the Rsyn7 promoter and other related constitutive promoters (International Publication No. WO 99/43838 and U.S. Pat. No. 6,072,050); the core CaMV 35S promoter (Odell et al., 1985, *Nature* 313:810-812); rice actin (McElroy et al., 1990, *Plant Cell* 2:163-171); ubiquitin (Christensen et al., 1989, *Plant Mol. Biol.* 12:619-632 and Christensen et al., 1992, *Plant Mol. Biol.* 18:675-689); pEMU (Last et al., 1991, *Theor. Appl. Genet.* 81:581-588); MAS (Velten et al., 1984, *EMBO J.* 3:2723-2730); ALS promoter (U.S. Pat. No. 5,659,026), and the like (e.g., U.S. Pat. Nos. 5,608,149; 5,608,144; 5,604,121; 5,569,597; 5,466,785; 5,399,680; 5,268,463; 5,608,142; and 6,177,611).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

Accordingly, the present invention provides a host cell having an expression vector comprising a nucleic acid of the invention, or a variant thereof. A host cell can be any prokaryotic (e.g., *E. coli, Bacillus thuringiensis*) or eukaryotic cell (e.g., insect cells, yeast or plant cells). The invention also provides a method for expressing a nucleic acid of the invention thus making the encoded polypeptide comprising the steps of i) culturing a cell comprising a nucleic acid molecule of the invention under conditions that allow production of the encoded polypeptide; and ii) isolating the expressed polypeptide.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid molecules into a host cell, including calcium phosphate or calcium chloride co-precipitation, DEAE-dextran-mediated transfection, lipofection, or electroporation. Suitable methods for transforming or transfecting host cells can be found in the art (e.g., Sambrook, et al. supra.).

5.7 Production of Transgenic Plants

Any method known in the art can be used for transforming a plant or plant cell with a nucleic acid molecule of the present invention. Nucleic acid molecules can be incorporated into plant DNA (e.g., genomic DNA or chloroplast DNA) or be maintained without insertion into the plant DNA (e.g., through the use of artificial chromosomes). Suitable methods of introducing nucleic acid molecules into plant cells include microinjection (Crossway et al., 1986, *Biotechniques* 4:320-334); electroporation (Riggs et al., 1986, *Proc. Natl. Acad. Sci.* 83:5602-5606; D'Halluin et al., 1992, *Plant Cell* 4:1495-1505); *Agrobacterium*-mediated transformation (U.S. Pat. Nos. 5,563,055 and 5,981,840, Osjoda et al., 1996, *Nature Biotechnology* 14:745-750; Horsch et al., 1984, *Science* 233: 496-498, Fraley et al., 1983, *Proc. Natl. Acad. Sci.* 80:4803, and *Gene Transfer to Plants*, Potrykus, ed., Springer-Verlag, Berlin 1995); direct gene transfer (Paszkowski et al., 1984, *EMBO J.* 3:2717-2722); ballistic particle acceleration (U.S. Pat. Nos. 4,945,050; 5,879,918; 5,886,244; 5,932,782; Tomes et al., 1995, "Direct DNA Transfer into Intact Plant Cells via Microprojectile Bombardment, in *Plant Cell Tissue, and Organ Culture: Fundamental Methods*, ed. Gamborg and Phillips, Springer-Verlag, Berlin; and McCabe et al., 1988, *Biotechnology* 6:923-926); virus-mediated transformation (U.S. Pat. Nos. 5,889,191, 5,889,190, 5,866,785, 5,589,367 and 5,316,931); pollen transformation (De Wet et al., 1985, in *The Experimental Manipulation of Ovule Tissues*, ed. Chapman et al., Longman, New York, pp. 197-209); Lec 1 transformation (U.S. patent application Ser. No. 09/435,054; International Publication No. WO 00/28058); whisker-mediated transformation (Kaeppler et al., 1990, *Plant Cell Reports* 9:415-418; Kaeppler et al., 1992, *Theor. Appl. Genet.* 84:560-566); and chloroplast transformation technology (Bogorad, 2000, *Trends in Biotechnology* 18: 257-263; Ramesh et al., 2004, *Methods Mol. Biol.* 274:301-7; Hou et al., 2003, *Transgenic Res.* 12:111-4; Kindle et al., 1991, *Proc. Natl. Acad. Sci.* 88:1721-5; Bateman and Purton, 2000, *Mol Gen Genet.* 263:404-10; Sidorov et al., 1999, *Plant J.* 19:209-216).

The choice of transformation protocols used for generating transgenic plants and plant cells can vary depending on the type of plant or plant cell, i.e., monocot or dicot, targeted for transformation. Examples of transformation protocols particularly suited for a particular plant type include those for: potato (Tu et al., 1998, *Plant Molecular Biology* 37:829-838; Chong et al., 2000, *Transgenic Research* 9:71-78); soybean (Christou et al., 1988, *Plant Physiol.* 87:671-674; McCabe et al., 1988, *BioTechnology* 6:923-926; Finer and McMullen, 1991, *In Vitro Cell Dev. Biol.* 27P:175-182; Singh et al., 1998, *Theor. Appl. Genet.* 96:319-324); maize (Klein et al., 1988, *Proc. Natl. Acad. Sci.* 85:4305-4309; Klein et al., 1988, *Biotechnology* 6:559-563; Klein et al., 1988, *Plant Physiol.* 91:440-444; Fromm et al., 1990, *Biotechnology* 8:833-839; Tomes et al., 1995, "Direct DNA Transfer into Intact Plant Cells via Microprojectile Bombardment," in *Plant Cell Tissue, and Organ Culture: Fundamental Methods*, ed. Gamborg (Springer-Verlag, Berlin)); cereals (Hooykaas-Van Slogteren et al., 1984, *Nature* 311:763-764; U.S. Pat. No. 5,736,369).

In some embodiments, more than one construct is used for transformation in the generation of transgenic plants and plant cells. Multiple constructs may be included in cis or trans positions. In preferred embodiments, each construct has a promoter and other regulatory sequences.

Transformed plant cells which are derived by any of the above transformation techniques can be cultured to regenerate a whole plant which possesses the transformed genotype and thus the desired phenotype. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in the art (e.g., Evans et al., *Protoplasts Isolation and Culture, Handbook of Plant Cell Culture*, pp. 124-176, MacMillilan Publishing Company, New York, 1983; and Binding, Regeneration of Plants, Plant Protoplasts, pp. 21-73, CRC Press, Boca Raton, 1985). Regeneration can also be obtained from plant callus, explants, organs, or parts thereof. Such regeneration techniques are also described in the art (e.g., Klee et al. 1987, Ann. Rev. of Plant Phys. 38:467-486).

The term "plant" includes whole plants, shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit (the mature ovary), plant tissue (e.g. vascular tissue, ground tissue, and the like) and cells (e.g. guard cells, egg cells, trichomes and the like), and progeny of same. The class of plants that can be used in methods of the present invention includes the class of higher and lower plants amenable to transformation techniques, including angiosperms (monocotyledonous and dicotyledonous plants), gymnosperms, ferns, and multicellular algae. Plants of a variety of ploidy levels, including aneuploid, polyploid, diploid, haploid and hemizygous plants are also included.

The nucleic acid molecules of the invention can be used to confer desired traits on essentially any plant. Thus, the invention has use over a broad range of plants, including species from the genera *Agrotis, Allium, Ananas, Anacardium, Apium, Arachis, Asparagus, Athamantha, Atropa, Avena, Bambusa, Beta, Brassica, Bromus, Browaalia, Camellia, Cannabis, Carica, Ceratonia. Cicer, Chenopodium, Chicorium, Citrus, Citrullus, Capsicum, Carthamus, Cocos, Coffea, Coix, Cucumis, Cucurbita, Cynodon, Dactylis, Datura, Daucus, Dianthus, Digitalis, Dioscorea, Elaeis, Eliusine, Euphorbia, Festuca, Ficus, Fragaria, Geranium, Glycine, Graminae, Gossypium, Helianthus, Heterocallis, Hevea, Hibiscus, Hordeum, Hyoscyamus, Ipomoea, Lactuca, Lathyrus, Lens, Lilium, Linum, Lolium, Lotus, Lupinus, Lycopersicon, Macadamia, Macrophylla, Malus, Mangifera, Manihot, Majorana, Medicago, Musa, Narcissus, Nemesia, Nicotiana, Onobrychis, Olea,* Olyreae, *Oryza, Panicum, Panicum, Panieum, Pannisetum, Pennisetum, Petunia, Pelargonium, Persea,* Pharoideae, *Phaseolus, Phleum, Picea, Poa, Pinus, Pistachia, Pisum, Populus, Pseudotsuga, Pyrus, Prunus, Pseutotsuga, Psidium, Quercus, Ranunculus, Raphanus, Ribes, Ricinus, Rhododendron, Rosa, Saccharum, Salpiglossis, Secale, Senecio, Setaria, Sequoia, Sinapis, Solanum, Sorghum, Stenotaphrum, Theobromus, Trigonella, Trifolium, Trigonella, Triticum, Tsuga, Tulipa, Vicia, Vitis, Vigna,* and *Zea.*

In specific embodiments, transgenic plants are maize, potato, rice, soybean or cotton plants.

Transgenic plants may be grown and pollinated with either the same transformed strain or different strains. Two or more generations of the plants may be grown to ensure that expression of the desired nucleic acid molecule, polypeptide and/or phenotypic characteristic is stably maintained and inherited. One of ordinary skill in the art will recognize that after the nucleic acid molecule of the present invention is stably incorporated in transgenic plants and confirmed to be operable, it can be introduced into other plants by sexual crossing. Any of a number of standard breeding techniques can be used, depending upon the species to be crossed.

5.8 Determination of Expression in Transgenic Plants

Any method known in the art can be used for determining the level of expression in a plant of a nucleic acid molecule of the invention or polypeptide encoded therefrom. For example, the expression level in a plant of a polypeptide encoded by a nucleic acid molecule of the invention can be determined by immunoassay, quantitative gel electrophoresis, etc. Additionally, the expression level in a plant of a polypeptide encoded by a nucleic acid molecule of the invention can be determined by the degree to which the plant phenotype is altered. In a specific embodiment, enhanced insect resistance is the phenotype to be assayed.

As used herein, "enhanced insect resistance" refers to increased resistance of a transgenic plant expressing a polypeptide of the invention to consumption and/or infestation by an insect pest as compared to a plant not expressing a polypeptide of the invention. Enhanced resistance can be measured in a number of ways. In one embodiment, enhanced resistance is measured by decreased damage to a plant expressing a polypeptide of the invention as compared to a plant not expressing a polypeptide of the invention after the same period of insect incubation. Insect damage can be assessed visually. For example in cotton plants, damage after infestation can be measured by looking directly at cotton plant bolls for signs of consumption by insects. In another embodiment, enhanced resistance is measured by increased crop yield from a plant expressing a polypeptide of the invention as compared to a plant not expressing a polypeptide of the invention after the same period of insect incubation. In particular embodiments, the insect pest are from the orders Lepidoptera and/or Diptera.

Determinations can be made using whole plants, tissues thereof, or plant cell culture.

The Sequence Listing that is 0.97 MB and was created on Feb. 24, 2005 and was submitted to the PCT authorities in the International Phase, is incorporated by reference in its entirety.

The contents of all published articles, books, reference manuals and abstracts cited herein, are hereby incorporated by reference in their entirety to more fully describe the state of the art to which the invention pertains.

As various changes can be made in the above-described subject matter without departing from the scope and spirit of the present invention, it is intended that all subject matter contained in the above description, and/or defined in the appended claims, be interpreted as descriptive and illustrative of the present invention. Modifications and variations of the present invention are possible in light of the above teachings.

6. EXAMPLES

6.1 Example 1

Primary Insect Screening

Primary insect screening identified Bt cultures from a biodiversity collection having activity against *Helicoverpa* spp. The screening was conducted with spore-crystal complex samples at one high dose against *Helicoverpa zea* neonate larvae.

Spore-crystal complex samples were prepared in deep-well production plates containing 1 ml CYS sporulation medium (Yamamoto, 1990, Analytical Chemistry of *Bacillus thuringiensis* 432:46-60). The production plates were inoculated with 10 μl seed cultures that had been kept frozen at −80° C. and incubated at 30° C., 350 rpm for 3 days until most cultures sporulated and released free spores and crystals. The plates were centrifuged at 4000 rpm, for 40 min to precipitate spores, crystals and unlysed cells. The precipitated spore-crystal complex was suspended in 1.2 ml 15 mM potassium acetate containing 100 μg lysozyme and incubated at 30° C., 250 rpm for 16 h to ensure full sporulation and cell lysis. After the 16-hr incubation, the spore-crystal complex was collected by centrifugation and suspended in 15 mM potassium acetate. This potassium acetate step was repeated once. The final spore-crystal suspension was made in 1 ml 15 mM potassium acetate and used to screen for *H. zea* activity.

Insect screening was done in shallow 96-well plates containing 150 μl artificial insect diet in each well. 20 μl of spore-crystal suspension was placed on the insect diet. About 5 neonate larvae were placed in each well. The insect assay plates were incubated at 29° C. for 3 days. Insect responses to Bt crystals included feeding inhibition and mortality. About 400 cultures showed substantial mortality and were therefore identified as positive. Cry2Ax was among the positives.

6.2 Example 2

DNA shuffling to isolate Cry2Ax-Derived Polypeptides

Starting with the Cry2Ax polypeptide (SEQ ID NO:2) and the Cry2Ab* polypeptide (Cry2Ab* has 2 amino acid changes relative to wild type Cry2Ab; K to R at position 36 and M to T at position 241 of GenBank Accession No. M23724), synthetic DNA templates were created for DNA shuffling. Using a phylogenetic comparison of Cry2Ab (Gen Bank Accession No. M23724) and Cry2Ax (SEQ ID NO:2) a library was created that varied the 40 amino acid positions (see Section 5.1) that were different between these two polypeptide sequences. Shuffled DNA libraries were created using oligonucleotide directed shuffling with the synthetic gene encoding Cry2Ax acting as the parental DNA template. The PCR DNA libraries were cloned into pMAXY3219 by replacing the Cry2Ab* gene. The toxin clones were built such that they are expressed as a fusion to the *E. coli* maltose binding protein (MBP). Primary insect screening identified cultures active against *Helicoverpa* spp. The screening was conducted by incorporating a small amount of *E. coli* culture expressing the MBP::Cry2Ax-derived polypeptide fusion at one low dose in artificial diet followed by infestation with *H. zea* larvae. Screening was done in shallow 96-well plates containing 150 μl artificial insect diet in each well. ~0.5 μl of MBP::Cry2Ax-derived polypeptide fusion expressing culture was incorporated into the insect diet. About 5 *H. zea* neonate larvae were placed in each well. The insect assay plates were incubated at 29° C. for 4 days. Insect responses to the *E. coli* samples included feeding inhibition and mortality. Those samples causing severe stunting or death to the larvae were re-arrayed for further analysis.

Screening of this first round library led to the discovery of several clones improved insecticidal activity relative to Cry2Ax and Cry2Ab*. In particular, clones 38 (D_S00503480) (SEQ ID NO:4) and 44 (D_S00503970) (SEQ ID NO:6) were found to be highly active when expressed (data not shown). These clones were therefore chosen for a successive round of DNA shuffling.

For the second round of shuffling, parent DNA templates from clones 38 (D_S00503480) (SEQ ID NO:4) and 44 (D_S00503970) (SEQ ID NO:6) were PCR amplified in the presence of uracil and then fragmented with uracil N-glycosylase. The fragmented templates were then mixed, reassembled before recombinant templates were amplified by PCR. A library of these shuffled templates was created in pMAXY3219 as described above. The sequence of some of the clones isolated from the first and second rounds of shuffling is shown in Table 3 indicating the amino acid residues that were changed.

In order to further diversify one of the top performing $2^{nd}$ Round hits, clone 473R (D_S01037677) (SEQ ID NO:18), the first 46 amino acid residues at the amino terminal region of the polypeptide were modified to contain residues found in eight different Cry2 polypeptide sequences (i.e., Cry2Aa, Cry2Ab, Cry2Ac, Cry2Ad, Cry2Ae, Cry2Af, Cry2Ag, and Cry2Ax). In addition, two residues, I13 and D15, were substituted with conservative residues valine and glutamate, respectively (see Table 4). The modified clone was termed clone 473N (SEQ ID NO:8).

6.3 Example 3

Activity of Cry2Ax-Derived Polypeptides

Screening of the activities of the shuffled clones was carried out in several stages. Initially the clones were screened for high insecticidal activity by providing a small amount of *E. coli* expressing a clone fusion protein into artificial diet for first instar *H. zea* larvae. Clones causing either complete death or complete stunting of the larvae were chosen for further study. Those clones that demonstrated high insecticidal activity were then used to create a new library in a plant expression vector in *Agrobacterium tumefaciens*. The library was screened by co-cultivating each clone in four replicates with *N. benthamiana* leaves (using forced infiltration of each respective culture), and then feeding each corresponding disk to a single $3^{rd}$ instar *H. zea* larvae. Following a 24-hour incubation period, the feeding activity was determined by visual observation and expressed as an approximate fraction of leaf area remaining.

The clones passing further repetition of the *E. coli* expression/diet incorporation assays were re-cloned individually into plant expression vector pMAXY4384 and tested for efficacy in planta as described above. A final in planta activity assessment of the best hits from the *E. coli* expression multi-tiered assay and the plant library approach is shown in FIG. 1. From this analysis several clones appeared to have increased insecticidal activity including 7K (D_S01000779) (SEQ ID NO: 10), 15K (D_S00999080) (SEQ ID NO:12), 16K (D_S01000269) (SEQ ID NO:14), 16R (D_S01037143) (SEQ ID NO:16), and 473R (D_S01037677) (SEQ ID NO:18).

6.4 Example 4

DNA Shuffling to Isolate Additional Cry2Ax-Derived Polypeptides

Clones 44 (D_S00503970) (SEQ ID NO:6), 473R (D_S01037677) (SEQ ID NO: 18) which were $1^{st}$ and $2^{nd}$ round shuffling hits as described Section 6.2 and Cry2Ab* were used as templates for further shuffling. Using these templates and oligonucleotide directed shuffling, derived polypeptides were created having amino acid diversity from wild type Cry2 polypeptides (i.e., Cry2Ae and Cry2Ag) as well as computer generated random conservative amino acid substitutions and random substitutions within segments of certain structural loop regions. The shuffled DNA libraries were cloned into pMAXY3219 by replacing the Cry2Ab* gene. The toxin clones were built such that they were expressed as a fusion to the *E. coli* maltose binding protein (MBP). A summary of the isolated sequences is shown in Tables 5-7.

6.5 Example 5

Activity of Additional Cry2Ax-Derived Polypeptides

In order to assess the activity of the shuffled derived polypeptides against the cotton pest *Helicoverpa zea*, high throughput screening using artificial diet containing whole *E. coli* cells expressing a clone fusion protein was performed as described supra. Clones having a high level of activity were further tested for in planta activity to confirm that the changes made to each derived polypeptide did not negatively impact gene expression or protein accumulation in plant cells. To initiate this process, each Cry2Ax-derived polypeptide was cloned into an *Agrobacterium tumefaciens* based plant expression vector, transformed into the host *Agrobacterium* strain and then arrayed into microtiter dishes. The hits were then screened by co-cultivating each in four replicates with *N. benthamiana* leaves (using forced infiltration of each respective culture), followed by feeding each corresponding disk to a single 3$^{rd}$ instar *H. zea* larvae. Following a 24-hour incubation period the feeding activity on each disc was determined by the visual capture and analysis method as described supra. Some derived polypeptides from this process were improved compared to the parental clones. One such clone is D_S01764701 (SEQ ID NO:134) that showed improved activity over clone 44. Feeding assay results are shown for three experiments in FIG. 2.

6.6 Example 6

Transgenic Plants Expressing Clone 44

Transgenic tobacco plants expressing clone 44 (D_S00503970) were generated by *Agrobacterium*-mediated transformation with glyphosate selection using binary vectors pMAXY5469 and pMAXY5471. These vectors contain a dSVBV driven GAT gene and a dMMV driven clone 44 nucleic acid molecule clone 44 (SEQ ID NO:5). pMAXY5469 differs from pMAXY5471 in that it contains plastid targeting signal fused to the coding region of clone 44 such that this toxin variant will accumulate in the plastid compartment. Approximately 25 transformants were generated for each construct. Leaf disks expressing clone 44 were placed on a bed of agar in a 48-well titer tray and then infested with either 3rd instar *Helicoverpa zea* larvae or 4th instar *Spodoptera exigua* larvae. The leaves were incubated 24 hrs with the worms and then the larvae which were then removed and the leaf remaining was observed with video capture equipment for actual calculation of relative leaf area remaining (number of pixels). Results using the top transformants for each vector are shown in FIG. 3A for the *H. zea* and FIG. 3B for the *S. exigua*. Each transgenic plant has 6 leaf disks taken for analysis as shown.

Expression of then clone 44 polypeptide in the transgenic tobacco plants in the plastid (FIG. 4A) or in the cytoplasmic compartment (FIG. 4B) was assayed by western blot using a polyclonal antibody directed to clone 44 polypeptide. Lane numbers in FIG. 4 correspond to plant numbers in FIG. 3.

The polyclonal antibody used in the western blot was prepared by immunizing chickens with purified trypsin truncated clone 44 polypeptide and then purifying Cry2 specific antibodies using an affinity column made with trypsin truncated clone 44 polypeptide as the substrate.

Figure 4:
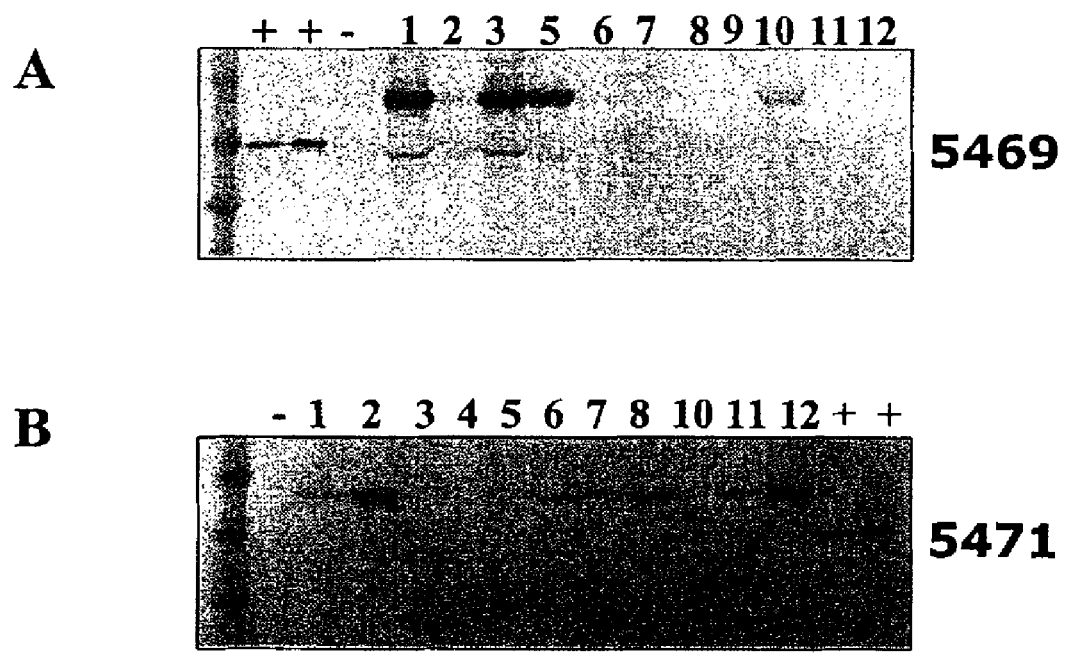

The most obvious difference between the two types of transgenic plants is that inhibition of *S. exigua* is much greater for the plastid-accumulated toxin (comparing right and left panels of FIG. 3B). These data in conjunction with the expression data (FIG. 4) showing that plants harboring the T-DNA derived from 5469 (FIG. 4A) are capable of producing far more toxin than those of 5471 (FIG. 4B).

TABLE 1

Cry2Ax and Cry2Ax-derived sequences

| Clone name | Type | SEQ ID NO |
|---|---|---|
| Cry2Ax | nucleic acid | 1 |
| Cry2Ax | polypeptide | 2 |
| 38 (D_S00503480) | nucleic acid | 3 |
| 38 (D_S00503480) | polypeptide | 4 |
| 44 (D_S00503970) | nucleic acid | 5 |
| 44 (D_S00503970) | polypeptide | 6 |
| 473N | nucleic acid | 7 |
| 473N | polypeptide | 8 |
| 7K (D_S01000779) | nucleic acid | 9 |
| 7K (D_S01000779) | polypeptide | 10 |
| 15K (D_S00999080) | nucleic acid | 11 |
| 15K (D_S00999080) | polypeptide | 12 |
| 16K (D_S01000269) | nucleic acid | 13 |
| 16K (D_S01000269) | polypeptide | 14 |
| 16R (D_S01037143) | nucleic acid | 15 |
| 16R (D_S01037143) | polypeptide | 16 |
| 473R (D_S01037677) | nucleic acid | 17 |
| 473R (D_S01037677) | polypeptide | 18 |
| D_S01466681 | nucleic acid | 19 |
| D_S01466681 | polypeptide | 20 |
| D_S01466770 | nucleic acid | 21 |
| D_S01466770 | polypeptide | 22 |
| D_S01467219 | nucleic acid | 23 |
| D_S01467219 | polypeptide | 24 |
| D_S01466712 | nucleic acid | 25 |
| D_S01466712 | polypeptide | 26 |
| D_S01467003 | nucleic acid | 27 |
| D_S01467003 | polypeptide | 28 |
| D_S01460229 | nucleic acid | 29 |
| D_S01460229 | polypeptide | 30 |
| D_S01459398 | nucleic acid | 31 |
| D_S01459398 | polypeptide | 32 |
| D_S01464856 | nucleic acid | 33 |
| D_S01464856 | polypeptide | 34 |
| D_S01465 7862 | nucleic acid | 35 |
| D_S01465 7862 | polypeptide | 36 |
| D_S01458733 | nucleic acid | 37 |
| D_S01458733 | polypeptide | 38 |
| D_S01457892 | nucleic acid | 39 |
| D_S01457892 | polypeptide | 40 |
| D_S01442158 | nucleic acid | 41 |
| D_S01442158 | polypeptide | 42 |
| D_S01443366 | nucleic acid | 43 |
| D_S01443366 | polypeptide | 44 |
| D_S01442132 | nucleic acid | 45 |
| D_S01442132 | polypeptide | 46 |
| D_S01532970 | nucleic acid | 47 |
| D_S01532970 | polypeptide | 48 |
| D_S01532041 | nucleic acid | 49 |
| D_S01532041 | polypeptide | 50 |
| D_S01611723 | nucleic acid | 51 |
| D_S01611723 | polypeptide | 52 |
| D_S01561293 | nucleic acid | 53 |
| D_S01561293 | polypeptide | 54 |
| D_S01561489 | nucleic acid | 55 |
| D_S01561489 | polypeptide | 56 |
| D_S01561330 | nucleic acid | 57 |
| D_S01561330 | polypeptide | 58 |
| D_S01570511 | nucleic acid | 59 |
| D_S01570511 | polypeptide | 60 |
| D_S01570809 | nucleic acid | 61 |

TABLE 1-continued

Cry2Ax and Cry2Ax-derived sequences

| Clone name | Type | SEQ ID NO |
|---|---|---|
| D_S01570809 | polypeptide | 62 |
| D_S01570568 | nucleic acid | 63 |
| D_S01570568 | polypeptide | 64 |
| D_S01572168 | nucleic acid | 65 |
| D_S01572168 | polypeptide | 66 |
| D_S01571315 | nucleic acid | 67 |
| D_S01571315 | polypeptide | 68 |
| D_S01571875 | nucleic acid | 69 |
| D_S01571875 | polypeptide | 70 |
| D_S01572374 | nucleic acid | 71 |
| D_S01572374 | polypeptide | 72 |
| D_S01572905 | nucleic acid | 73 |
| D_S01572905 | polypeptide | 74 |
| D_S01572908 | nucleic acid | 75 |
| D_S01572908 | polypeptide | 76 |
| D_S01561856 | nucleic acid | 77 |
| D_S01561856 | polypeptide | 78 |
| D_S01573294 | nucleic acid | 79 |
| D_S01573294 | polypeptide | 80 |
| D_S01571529 | nucleic acid | 81 |
| D_S01571529 | polypeptide | 82 |
| D_S01599948 | nucleic acid | 83 |
| D_S01599948 | polypeptide | 84 |
| D_S01601459 | nucleic acid | 85 |
| D_S01601459 | polypeptide | 86 |
| D_S01602925 | nucleic acid | 87 |
| D_S01602925 | polypeptide | 88 |
| D_S01613034 | nucleic acid | 89 |
| D_S01613034 | polypeptide | 90 |
| D_S01614407 | nucleic acid | 91 |
| D_S01614407 | polypeptide | 92 |
| D_S01631557 | nucleic acid | 93 |
| D_S01631557 | polypeptide | 94 |
| D_S01633080 | nucleic acid | 95 |
| D_S01633080 | polypeptide | 96 |
| D_S01632237 | nucleic acid | 97 |
| D_S01632237 | polypeptide | 98 |
| D_S01633031 | nucleic acid | 99 |
| D_S01633031 | polypeptide | 100 |
| D_S01632121 | nucleic acid | 101 |
| D_S01632121 | polypeptide | 102 |
| D_S01764500 | nucleic acid | 103 |
| D_S01764500 | polypeptide | 104 |
| D_S01764502 | nucleic acid | 105 |
| D_S01764502 | polypeptide | 106 |
| D_S01764505 | nucleic acid | 107 |
| D_S01764505 | polypeptide | 108 |
| D_S01764533 | nucleic acid | 109 |
| D_S01764533 | polypeptide | 110 |
| D_S01764543 | nucleic acid | 111 |
| D_S01764543 | polypeptide | 112 |
| D_S01764546 | nucleic acid | 113 |
| D_S01764546 | polypeptide | 114 |
| D_S01764554 | nucleic acid | 115 |
| D_S01764554 | polypeptide | 116 |
| D_S01764568 | nucleic acid | 117 |
| D_S01764568 | polypeptide | 118 |
| D_S01764569 | nucleic acid | 119 |
| D_S01764569 | polypeptide | 120 |
| D_S01764577 | nucleic acid | 121 |
| D_S01764577 | polypeptide | 122 |
| D_S01764642 | nucleic acid | 123 |
| D_S01764642 | polypeptide | 124 |
| D_S01764643 | nucleic acid | 125 |
| D_S01764643 | polypeptide | 126 |
| D_S01764680 | nucleic acid | 127 |
| D_S01764680 | polypeptide | 128 |
| D_S01764685 | nucleic acid | 129 |
| D_S01764685 | polypeptide | 130 |
| D_S01764691 | nucleic acid | 131 |
| D_S01764691 | polypeptide | 132 |
| D_S01764701 | nucleic acid | 133 |
| D_S01764701 | polypeptide | 134 |
| D_S01764706 | nucleic acid | 135 |
| D_S01764706 | polypeptide | 136 |
| D_S01764723 | nucleic acid | 137 |
| D_S01764723 | polypeptide | 138 |
| D_S02847715 | nucleic acid | 139 |
| D_S02847715 | polypeptide | 140 |
| D_S01765051 | nucleic acid | 141 |
| D_S01765051 | polypeptide | 142 |
| D_S01765068 | nucleic acid | 143 |
| D_S01765068 | polypeptide | 144 |
| D_S01765100 | nucleic acid | 145 |
| D_S01765100 | polypeptide | 146 |
| D_S01765063 | nucleic acid | 147 |
| D_S01765063 | polypeptide | 148 |
| D_S01765119 | nucleic acid | 149 |
| D_S01765119 | polypeptide | 150 |
| D_S01765104 | nucleic acid | 151 |
| D_S01765104 | polypeptide | 152 |
| D_S01765112 | nucleic acid | 153 |
| D_S01765112 | polypeptide | 154 |
| D_S01765174 | nucleic acid | 155 |
| D_S01765174 | polypeptide | 156 |
| D_S01765242 | nucleic acid | 157 |
| D_S01765242 | polypeptide | 158 |
| D_S01765308 | nucleic acid | 159 |
| D_S01765308 | polypeptide | 160 |
| D_S01765221 | nucleic acid | 161 |
| D_S01765221 | polypeptide | 162 |
| D_S01765254 | nucleic acid | 163 |
| D_S01765254 | polypeptide | 164 |
| D_S01765231 | nucleic acid | 165 |
| D_S01765231 | polypeptide | 166 |
| D_S01765255 | nucleic acid | 167 |
| D_S01765255 | polypeptide | 168 |
| D_S01765377 | nucleic acid | 169 |
| D_S01765377 | polypeptide | 170 |
| D_S01765430 | nucleic acid | 171 |
| D_S01765430 | polypeptide | 172 |
| D_S01765446 | nucleic acid | 173 |
| D_S01765446 | polypeptide | 174 |
| D_S01765496 | nucleic acid | 175 |
| D_S01765496 | polypeptide | 176 |
| D_S01764642 | nucleic acid | 177 |
| D_S01764642 | polypeptide | 178 |
| D_S01766041 | nucleic acid | 179 |
| D_S01766041 | polypeptide | 180 |
| D_S01764706 | nucleic acid | 181 |
| D_S01764706 | polypeptide | 182 |
| D_S01766073 | nucleic acid | 183 |
| D_S01766073 | polypeptide | 184 |
| D_S01764643 | nucleic acid | 185 |
| D_S01764643 | polypeptide | 186 |
| D_S01763985 | nucleic acid | 187 |
| D_S01763985 | polypeptide | 188 |
| D_S01764668 | nucleic acid | 189 |
| D_S01764668 | polypeptide | 190 |
| D_S01764196 | nucleic acid | 191 |
| D_S01764196 | polypeptide | 192 |
| D_S01764728 | nucleic acid | 193 |
| D_S01764728 | polypeptide | 194 |
| D_S01764787 | nucleic acid | 195 |
| D_S01764787 | polypeptide | 196 |
| D_S01764758 | nucleic acid | 197 |
| D_S01764758 | polypeptide | 198 |
| D_S01764768 | nucleic acid | 199 |
| D_S01764768 | polypeptide | 200 |
| D_S01764860 | nucleic acid | 201 |
| D_S01764860 | polypeptide | 202 |
| D_S01765018 | nucleic acid | 203 |
| D_S01765018 | polypeptide | 204 |
| D_S01764947 | nucleic acid | 205 |
| D_S01764947 | polypeptide | 206 |
| D_S01764934 | nucleic acid | 207 |
| D_S01764934 | polypeptide | 208 |
| D_S01764968 | nucleic acid | 209 |

TABLE 1-continued

Cry2Ax and Cry2Ax-derived sequences

| Clone name | Type | SEQ ID NO |
|---|---|---|
| D_S01764968 | polypeptide | 210 |
| D_S01765008 | nucleic acid | 211 |
| D_S01765008 | polypeptide | 212 |
| D_S01764953 | nucleic acid | 213 |
| D_S01764953 | polypeptide | 214 |
| D_S01764977 | nucleic acid | 215 |
| D_S01764977 | polypeptide | 216 |
| D_S01765509 | nucleic acid | 217 |
| D_S01765509 | polypeptide | 218 |
| D_S01765668 | nucleic acid | 219 |
| D_S01765668 | polypeptide | 220 |
| D_S01765621 | nucleic acid | 221 |
| D_S01765621 | polypeptide | 222 |
| D_S01765693 | nucleic acid | 223 |
| D_S01765693 | polypeptide | 224 |
| D_S01765687 | nucleic acid | 225 |
| D_S01765687 | polypeptide | 226 |
| D_S01765765 | nucleic acid | 227 |
| D_S01765765 | polypeptide | 228 |
| D_S01765932 | nucleic acid | 229 |
| D_S01765932 | polypeptide | 230 |
| D_S01766010 | nucleic acid | 231 |
| D_S01766010 | polypeptide | 232 |
| D_S01766026 | nucleic acid | 233 |
| D_S01766026 | polypeptide | 234 |
| D_S02838294 | nucleic acid | 235 |
| D_S02838294 | polypeptide | 236 |
| D_S02838310 | nucleic acid | 237 |
| D_S02838310 | polypeptide | 238 |
| D_S02838327 | nucleic acid | 239 |
| D_S02838327 | polypeptide | 240 |
| D_S02838328 | nucleic acid | 241 |
| D_S02838328 | polypeptide | 242 |
| D_S02838330 | nucleic acid | 243 |
| D_S02838330 | polypeptide | 244 |
| D_S02838454 | nucleic acid | 245 |
| D_S02838454 | polypeptide | 246 |
| D_S02838470 | nucleic acid | 247 |
| D_S02838470 | polypeptide | 248 |
| D_S02838478 | nucleic acid | 249 |
| D_S02838478 | polypeptide | 250 |
| D_S02838434 | nucleic acid | 251 |
| D_S02838434 | polypeptide | 252 |
| D_S02838549 | nucleic acid | 253 |
| D_S02838549 | polypeptide | 254 |
| D_S02838632 | nucleic acid | 255 |
| D_S02838632 | polypeptide | 256 |
| D_S02838640 | nucleic acid | 257 |
| D_S02838640 | polypeptide | 258 |
| D_S02838648 | nucleic acid | 259 |
| D_S02838648 | polypeptide | 260 |
| Cry2Ab | polypeptide | 261 |

TABLE 2

Codon Table

| Amino acids | | | Codon |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | L | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

TABLE 3

Sequence of clones of interest isolated from DNA shuffling

| Amino acid position | Parents | | 1st Rd | | 2nd Rd | | | | | |
|---|---|---|---|---|---|---|---|---|---|---|
| | 2Ab | 2Ax | 38 | 44 | 7K | 15K | 16K | 16R | 473R | |
| 3 | N | H | H | H | H | H | H | H | H | Amino |
| 4 | S | N | N | N | N | N | N | N | N | Acid |
| 20 | A | V | A | A | A | A | A | A | A | Se- |
| 35 | V | I | V | V | V | V | V | V | V | quence |
| 37 | K | E | E | E | E | E | E | E | E | |
| 40 | T | M | M | M | M | M | M | M | M | |
| 42 | W | W | W | W | W | W | R | W | W | |
| 45 | N | D | D | D | D | D | D | D | D | |
| 51 | L | V | V | V | V | L | L | V | V | |
| 80 | N | N | S | N | S | S | S | S | S | |
| 163 | P | T | T | P | P | P | P | P | P | |
| 210 | R | R | Q | R | R | R | R | Q | R | |
| 211 | D | N | N | N | N | N | N | N | N | |
| 212 | Y | H | H | H | H | H | H | H | H | |
| 214 | K | R | R | R | R | R | R | R | R | |
| 230 | S | T | S | T | S | S | S | S | T | |
| 233 | K | R | R | R | R | R | R | R | R | |
| 242 | M | M | M | M | V | M | M | M | M | |
| 318 | S | T | S | S | S | S | S | S | S | |
| 319 | N | Q | Q | Q | Q | Q | Q | Q | Q | |
| 330 | S | T | T | T | T | T | T | T | T | |
| 347 | I | V | V | V | V | V | V | V | V | |
| 355 | S | — | S | S | S | S | S | S | S | Amino |
| 356 | P | V | P | P | P | P | P | P | P | Acid |
| 358 | N | N | T | N | T | T | T | N | N | Se- |
| 362 | N | S | S | S | S | S | S | S | S | quence |
| 386 | E | G | G | G | G | G | G | G | G | |
| 388 | V | I | V | V | V | V | V | V | V | |
| 389 | A | N | A | N | A | N | N | A | A | |
| 447 | E | Q | Q | Q | Q | Q | Q | Q | Q | |
| 452 | A | E | E | A | E | A | A | A | E | |
| 461 | A | L | A | L | A | L | L | A | A | |
| 477 | H | Y | Y | Y | Y | Y | Y | Y | Y | |

TABLE 3-continued

| Sequence of clones of interest isolated from DNA shuffling | | | | | | | | | |
|---|---|---|---|---|---|---|---|---|---|
| Amino acid po- | Parents | | $1^{st}$ Rd | | $2^{nd}$ Rd | | | | |
| sition | 2Ab | 2Ax | 38 | 44 | 7K | 15K | 16K | 16R | 473R |
| 484 | S | T | T | S | T | S | T | T | T |
| 490 | N | E | E | E | E | E | E | E | E |
| 529 | N | S | S | S | S | S | S | S | S |
| 570 | T | S | S | T | T | S | S | S | T |
| 600 | S | D | D | S | S | S | S | S | D |
| 602 | S | T | S | S | S | S | S | S | S |

TABLE 3-continued

| Sequence of clones of interest isolated from DNA shuffling | | | | | | | | | |
|---|---|---|---|---|---|---|---|---|---|
| Amino acid po- | Parents | | $1^{st}$ Rd | | $2^{nd}$ Rd | | | | |
| sition | 2Ab | 2Ax | 38 | 44 | 7K | 15K | 16K | 16R | 473R |
| 603 | D | N | N | D | D | D | D | D | N |
| 619 | D | E | E | D | D | E | E | D | D |
| 625 | L | F | F | F | F | F | F | F | F |
| 630 | I | L | L | L | L | L | L | L | L |
| 631 | S | P | S | P | P | S | S | P | P |

TABLE 4

| Sequence comparison of wild type Cry2 polypeptides with clone 473N | | | | | | | | | | | |
|---|---|---|---|---|---|---|---|---|---|---|---|
| Amino acid | Parents | | | | | | | | | Modified Clone | |
| position | Cry2Aa | Cry2Ab | Cry2Ac | Cry2Ad | Cry2Ae | Cry2Af | Cry2Ag | Cry2Ax | 473R | 473N | |
| 8 | S | S | N | S | N | S | S | S | S | N | Amino |
| 9 | S | G | G | G | G | G | E | G | G | E | Acid |
| 11 | S | T | N | N | T | T | T | T | T | N | Sequence |
| 13 | S | I | T | I | I | I | K | I | I | V | |
| 15 | S | D | H | D | D | D | G | D | D | E | |
| 17 | S | Y | H | Y | Y | Y | Y | Y | Y | H | |
| 21 | S | A | A | V | A | A | A | A | A | V | |
| 22 | S | H | H | H | H | H | H | H | H | R | |
| 28 | S | Q | E | Q | E | Q | E | Q | Q | E | |
| 36 | S | Q | E | D | R | Q | Q | Q | Q | E | |
| 37 | S | K | K | N | K | E | K | E | E | K | |
| 40 | S | T | K | M | M | M | M | M | M | T | |
| 44 | S | K | R | K | R | K | R | K | K | R | |
| 45 | S | N | T | D | T | D | T | D | D | N | |
| 46 | S | N | D | N | D | N | D | N | N | D | |

TABLE 5

| Sequence of clones of interest isolated from DNA shuffling using Cry2Ab* as parent | | | | | | | | | | | | | | | | | | | | | | | | | | | |
|---|---|---|---|---|---|---|---|---|---|---|---|---|---|---|---|---|---|---|---|---|---|---|---|---|---|---|---|
| | Sample | | | | | | | | | | | | | | | | | | | | | | | | | | |
| | 1 | 3 | 4 | 7 | 9 | 10 | 11 | 12 | 13 | 14 | 20 | 25 | 26 | 27 | 28 | 29 | 31 | 34 | 36 | 37 | 42 | 46 | 48 | 49 | 51 | 54 | 56 |
| Cry2Ab* | M | N | S | N | G | R | T | T | I | C | A | F | S | F | Q | H | S | T | Q | R | W | N | S | L | L | I | G |
| Cry2Ab wt seq | | | | | | | | | | | | | | | | | | | | K | | | | | | | |
| D_S02838648 | | | | D | | | | | | | | | | | | | P | | | R | R | | | | | | |
| D_S02838640 | | | | | | | | | | | | | | | | | | | | R | | | | | | | |
| D_S02838632 | | | | | | | | | | | | | | | | | | | R | R | | | | P | | | |
| D_S02838470 | | | | | | | | | | | | | | | | | | | | R | | | | | | | |
| D_S02838434 | | | | | | | | | | | | | | | | | | | | R | | | | | | | |
| D_S02838328 | | | | | | | | | | | | | | | | | | | | R | | | | | | | |
| D_S02838327 | | | | | | | | | | | | | | | | | | | | R | | | | | | | |
| D_S02838310 | | | | | | | | | | | | | | | | | | | | R | | | | | | | |
| D_S01766073 | | | | | | | | | | | | | | | | | | | | R | | | | | | | |
| D_S01766026 | | | | | | | | | | | | | | | | | | | | R | | D | | | | | |
| D_S01765621 | | | | | | | | | | | | | | | | | | | | R | | | | | | | |
| D_S01765509 | | | | | | | | | | | | | | | | | | | | R | | | | | | | |
| D_S01765496 | | | | | | | | | | | | | | | R | | | | | R | | | | | | | |
| D_s01765255 | | | | | | | | | | | | | | | R | | | | | R | | | | | | | |
| D_S01765119 | | | | | | | | | | | | | | | | | | | | R | | | | | | | |
| D_S01765112 | | | | | | | | | T | R | | | | | | | | | | R | | | | | V | V | |
| D_S01765104 | | | | | | H | | | | | | | | | | | | | | R | | | | | | | |
| D_S01765063 | | | | | | | | | | | | | | | | | | | | R | | | | | | | |
| D_S01765008 | | | | | | | | | | | | | | | | | | | | R | | | | | | | |
| D_S01764977 | | | | | | | | | | | | | | | | | | | | R | | | | | | | |
| D_S01764947 | | | | | | | | | | | | | L | | | | | | | R | | | | | | | |
| D_S01764787 | | | | | | | | | | | | | | | | | | | | R | | | | | | | |
| D_S01764723 | | | | | | | | | | | | | L | | | | | | | R | | | | | | | |

TABLE 5-continued

Sequence of clones of interest isolated from DNA shuffling using Cry2Ab* as parent

| | | | | | | | | | | | | | | |
|---|---|---|---|---|---|---|---|---|---|---|---|---|---|---|
| D__S01764701 | | | | | | | | | | | | R | | |
| D__S01764691 | | | | | | | | | | | | R | | |
| D__S01764680 | | | | | | | | S | | | S | R | | |
| D__S01764668 | | | | | | | | | | | | R | | |
| D__S01764642 | | | | | | | | | | | | R | | |
| D__S01764568 | | | | | | | | | | | | R | | |
| D__S01764554 | | | | | | | | | | | | R | | |
| D__S01764546 | | | | | | | | | | | | R | | |
| D__S01764543 | | | | | | | | | | | | R | | |
| D__S01764533 | | | | | | | | | | | | R | | |
| D__S01764505 | | H | N | | | | V | | | | | R | | |
| D__S01764502 | | | | | | A | | | | | | R | | |
| D__S01764500 | | | | | | | | | | | | R | | |
| D__S01764196 | | | | S | | | | | | | | R | | |
| D__S01763985 | | | | | | | | | | | | R | | |
| D__S01632237 | | | | | | | | | | | | R | | |
| D__S01632121 | | | | | A | | | | | | | R | | |
| D__S01631557 | | | | | | | | | | | | R | | |
| D__S01614407 | | | | | | | | | | | | R | | |
| D__S01613034 | | | | | | | | | | | | R | | R |
| D__S01602925 | | | | | | | | | | | | R | | |
| D__S01601459 | | | | | | | | | | | | R | | |
| D__S01599948 | | | | | | | | | | | | R | | |
| D__S01532970 | | | | | | | | | | R | | R | | |
| D__S0153204 | | H | N | | | | | | S | | | R | | |
| D__S01467003 | | | | | | | | | | | | R | | |
| D__S01466770 | | | | | | | | | | | | R | | |
| D__S01466712 | | | | | | | | | | | | R | | |
| D__S01466681 | | H | | | | | | | | | | | | |
| D__S014657862 | I | | | | | | | | | | | R | | |
| D__S01457892 | | | | | | | | | | | | R | | |
| D__S01443366 | | | | | | | | | | | | R | | |
| D__S01442158 | | | | | | | | | | | | R | L | |
| D__S01442132 | | | | | | | | | | | | R | | |
| D__S-1764685 | | | | | | | | | | | | R | | |
| BY2__Cry2Ab | | | | | | | | | | | | R | | |

| | Sample | | | | | | | | | | | | | | | | | | | | |
|---|---|---|---|---|---|---|---|---|---|---|---|---|---|---|---|---|---|---|---|---|---|
| | 64 | 70 | 76 | 79 | 80 | 89 | 93 | 96 | 97 | 100 | 101 | 107 | 111 | 118 | 119 | 122 | 123 | 124 | 125 | 126 | 130 |
| Cry2Ab* | K | V | S | R | N | N | D | R | E | K | F | N | L | L | T | Q | A | N | V | E | R |
| Cry2Ab wt seq | | | | | | | | | | | | | | | | | | | | | |
| D__S02838648 | | | | | S | | | | | | L | | | | E | | | | | | |
| D__S02838640 | | | | | S | | | | | | | | | | E | | | | | | |
| D__S02838632 | | | | | | | | | | | | | | | | | | | | | |
| D__S02838470 | | | | | | | | | | Q | | | | | | | | | | | |
| D__S02838434 | | | | | S | | | | | | | | | | | | | | | | |
| D__S02838328 | | | | | | | | | | | | | | | | | | | | | |
| D__S02838327 | | | | | S | | | | | E | | | | | | | | | | | |
| D__S02838310 | | | | | | | | | | | | | | | | | | | | | |
| D__S01766073 | | | | | | | | | | | | | | | | | | | | | |
| D__S01766026 | | | | W | | | | | | E | | | | | | | | | | | |
| D__S01765621 | | | | | G | | | | | | | D | | | | | | | | | |
| D__S01765509 | | | | | | | | | | | | | | | | | | | | | |
| D__S01765496 | | I | | | | | | | | | | | | | | | | | | | |
| D__s01765255 | | | | | | | | | | | | | | | | | | | | | Q |
| D__S01765119 | | | | | | | | | | Q | | | | | | | | | | | |
| D__S01765112 | | | | | | D | | | | | | | | | | | | | | | |
| D__S01765104 | | | | | | | | H | | | | | W | | | | | | | | |
| D__S01765063 | | | | | | | | | | Q | | D | | | | | | | | | |
| D__S01765008 | | | | W | G | | | | | | | | | | | | | | | | |
| D__S01764977 | | | | W | | | | | | Q | | | | | | | | | | | |
| D__S01764947 | | | | K | S | | | | | Q | | | | | | | | | | | |
| D__S01764787 | | | | W | | | | | | | | | | | | | | | | | |
| D__S01764723 | | | | W | G | | | | | | | | | M | | | | | | | |
| D__S01764701 | | | | | | | | | | Q | | D | | | | | | | | | |
| D__S01764691 | | | | | | | | | | | | | | | | | | | | | |
| D__S01764680 | | | | | | | | | | | | | | | | | | | | | |
| D__S01764668 | | | | W | G | | | | | | | | | | | R | | | | | |
| D__S01764642 | | | L | | | | | | | Q | | | | | | | | | | | |
| D__S01764568 | | | | | | | | | | | | | | | | | | G | I | | |
| D__S01764554 | | | | | S | | | | | R | | | | | | | | | | | |
| D__S01764546 | | | | | | | | | | Q | | | | | | | | | | | |
| D__S01764543 | E | | | | S | | | | | | | | | | | | | | | | |
| D__S01764533 | | | | W | | | | | | | | | | | | | | | | | |
| D__S01764505 | | | | | | | | | | | | | | | | | S | | | | |

TABLE 5-continued

Sequence of clones of interest isolated from DNA shuffling using Cry2Ab* as parent

| Clone | | | | | | | | | | | | | |
|---|---|---|---|---|---|---|---|---|---|---|---|---|---|
| D_S01764502 | W | G | | | Q | | | | | R | | | |
| D_S01764500 | | G | | | | | | | | | | | |
| D_S01764196 | | S | G | | | | | | | | | | |
| D_S01763985 | | | | | | | | | | | | | |
| D_S01632237 | | S | | | | | | | | | | | |
| D_S01632121 | | S | | | | | | | | | | | |
| D_S01631557 | | S | V | | | | | | | | | | H |
| D_S01614407 | | | | G | R | | | | | | | | |
| D_S01613034 | | | | | | | | | | | | | |
| D_S01602925 | | S | | | | | | | | | | | |
| D_S01601459 | | S | | | | | | E | | | | | |
| D_S01599948 | | S | | G | | | | | | | | | |
| D_S01532970 | | | | | | | | | | | | | |
| D_S0153204 | | | | | | | | | | | | G | |
| D_S01467003 | | | | | | | | | | | | | |
| D_S01466770 | | | | | | | | | | | | | |
| D_S01466712 | | | | | | | | | | | | | |
| D_S01466681 | | | | | | | | | | | | | |
| D_S014657862 | | | | | | S | | R | | | | | H |
| D_S01457892 | | | | | | | | | | | | | |
| D_S01443366 | | | | | | | | | | | | | |
| D_S01442158 | | | | | | | | | | | | | |
| D_S01442132 | | | | | | | | | | | | | |
| D_S-1764685 | | | | | | | | | | | | | |
| BY2_Cry2Ab | | S | | | | | | E | | | | | |

| | Sample | | | | | | | | | | | | | | | | | |
|---|---|---|---|---|---|---|---|---|---|---|---|---|---|---|---|---|---|---|
| | 135 | 137 | 139 | 140 | 141 | 142 | 144 | 153 | 154 | 160 | 162 | 164 | 166 | 167 | 168 | 169 | 172 | 178 |
| Cry2Ab* | F | N | N | R | N | A | P | T | M | N | L | Q | Q | M | Q | G | L | F |
| Cry2Ab wt seq | | | | | | | | | | | | | | | | | | |
| D_S02838648 | | | | | | | | | | | | | | | | | | |
| D_S02838640 | | | P | | D | I | | | | | | | | | | | | |
| D_S02838632 | | | P | L | S | I | | | | | | | | | Q | | | |
| D_S02838470 | | | | | | T | | | | | | | | | | | | |
| D_S02838434 | L | | | | | | | | | | | | | | | | | L |
| D_S02838328 | | | | | | | | | | | | | | | | | | |
| D_S02838327 | | | | L | D | T | | | | | | | | | | | | |
| D_S02838310 | | | | | | | | | | | | | | | | | | |
| D_S01766073 | | | | | | | | | | | | | | | | | | |
| D_S01766026 | | | | | | Q | | | | | | | | | | | | |
| D_S01765621 | | | | | | | | | | | | | | | | | | |
| D_S01765509 | | | | | | | | | | | | | R | V | | | | |
| D_S01765496 | | | | | | | | | | | | | | | | | | |
| D_s01765255 | | | | | | | | | | | | | | V | | | | |
| D_S01765119 | | | | | | | | L | | | | | | | | | | |
| D_S01765112 | | | | | | | | | A | | | | | | | | | |
| D_S01765104 | | | | | | | | | | | S | | | | | | | |
| D_S01765063 | | | | | | | | | | | | | | | | | | |
| D_S01765008 | | | | | | | | | | S | | | | V | | | | |
| D_S01764977 | | | | | | | | | | | | | | | | | | |
| D_S01764947 | | | | | | | | | | | | | | | | | | |
| D_S01764787 | | Y | | | | | | | | | | | | V | | | | |
| D_S01764723 | | | | Q | | | | | L | | | | R | V | | | | |
| D_S01764701 | | | | | | | | | | | | | | | | | | |
| D_S01764691 | | | | | | | | | | | | | | | | | | |
| D_S01764680 | | | | | | | | | | | | | R | | | | | |
| D_S01764668 | | | | | | | | | | | | | | | | | | |
| D_S01764642 | | | | | | | | | | | | | | V | | | | |
| D_S01764568 | | | | | | | | | | | | | | | | | | |
| D_S01764554 | | | | | | | | | | | | | | | | | | |
| D_S01764546 | | | | | | | | | | | | | | | | | | |
| D_S01764543 | | | | | | | | | | | | | | | | | | |
| D_S01764533 | | T | | | | | | | | | | | | | | | | |
| D_S01764505 | | | | | | | | | | | | | | | | | | |
| D_S01764502 | | | | Q | | | | | | | | | | | | | | |
| D_S01764500 | | T | | Q | | | | | | | | | | V | | | | |
| D_S01764196 | | | | | | | | | | | | | | | R | | S | |
| D_S01763985 | | | | | | | | | | | | | | | | | | |
| D_S01632237 | | | | | | | | | | | | | | R | Q | | | |
| D_S01632121 | | | | | | | | | | | | | | | | | | |
| D_S01631557 | | | | | | | | | | | | | | | | | | |
| D_S01614407 | | | | | | | | | | | | | | | | | | |
| D_S01613034 | | | | | | | | | | | | | | | | | | |
| D_S01602925 | | | | | | | | | | | | | | | | | | |
| D_S01601459 | | | | | | | | | | | | | | | | | | |

TABLE 5-continued

Sequence of clones of interest isolated from DNA shuffling using Cry2Ab* as parent

| Clone | | | | | | | |
|---|---|---|---|---|---|---|---|
| D_S01599948 | | | | | | | |
| D_S01532970 | | | | | | | |
| D_S0153204 | | | | | | | |
| D_S01467003 | | | | | | | |
| D_S01466770 | | | | | | | |
| D_S01466712 | | | T | | | | |
| D_S01466681 | | | | | | | |
| D_S014657862 | | | | | | M | |
| D_S01457892 | | | | | | | |
| D_S01443366 | | | | | | | |
| D_S01442158 | | | | | | | |
| D_S01442132 | | | | | | | |
| D_S-1764685 | | | | | | | |
| BY2_Cry2Ab | | | | | | | |

| | Sample | | | | | | | | | | | | | | | | | |
|---|---|---|---|---|---|---|---|---|---|---|---|---|---|---|---|---|---|---|
| | 184 | 187 | 191 | 192 | 193 | 197 | 201 | 205 | 210 | 211 | 212 | 214 | 215 | 216 | 218 | 219 | 221 | 226 |
| Cry2Ab* | L | S | D | V | I | D | I | T | R | D | Y | K | N | Y | R | D | S | N |
| Cry2Ab wt seq | | | | | | | | | | | | | | | | | | |
| D_S02838648 | | | | | G | | | | | | | | | | | | | |
| D_S02838640 | | | | | | | | | | | | | | | | | | |
| D_S02838632 | | | | | | | | | | | | | | | | | | |
| D_S02838470 | | | | | | | | | | | | | | | | | | |
| D_S02838434 | | | | | | | | | | | | R | | | | | | |
| D_S02838328 | M | | | | | | | | | | | | | | | | | |
| D_S02838327 | | | | | | | | | | | | | | | | | | |
| D_S02838310 | | | | | | | | | Q | | | | | | | | | |
| D_S01766073 | | | | | | | | | | | | | | | | | | |
| D_S01766026 | M | | | | | | | | | | | | | | | | | |
| D_S01765621 | | | | | V | | V | | | | | | | | | T | | |
| D_S01765509 | | | | | V | | | | | | | | | | | | | |
| D_S01765496 | | | | | | | | | | | | | | | | | | |
| D_s01765255 | M | | | | V | | | | | | | | | | | | | |
| D_S01765119 | | | | | | | | | | | | | | | | | | |
| D_S01765112 | | | | | | | | | Q | N | H | R | | | | | | |
| D_S01765104 | M | | E | | | | | | | | | | | | | | | |
| D_S01765063 | | | | | | | | | | | | | | | | | | |
| D_S01765008 | M | | | | V | | | | | | | | | | | | | |
| D_S01764977 | | | | | | | | | | | | | | | | | | |
| D_S01764947 | | | | | | | | | | | | | | | | | | |
| D_S01764787 | | | | | | | | | | | | | | | | | | |
| D_S01764723 | | | | | V | | | | | | | | | | | | | |
| D_S01764701 | | | | | | | | | | | | | | | | | | |
| D_S01764691 | | | | | | | | | | | | | | | | | | |
| D_S01764680 | M | | | | V | | | | | | | | | | | | | |
| D_S01764668 | M | | | | | | | | | | | | | | | E | | |
| D_S01764642 | M | | | | V | | | | | | | | | | | E | | |
| D_S01764568 | | | | | | | | | | | | | | | | | | |
| D_S01764554 | | | | A | | | | | Q | | | | | | | | | S |
| D_S01764546 | | | | | | | | A | | | | | | | | | | |
| D_S01764543 | | | | | | | | | | | | | | | | | | |
| D_S01764533 | | | | | V | | | | | | | | | | | | | |
| D_S01764505 | | | | | | | | | | | | | | | | | | |
| D_S01764502 | | G | | | V | A | | | | | | | | | | | | |
| D_S01764500 | | | | | | | | | | | | | | | | | | |
| D_S01764196 | | | | | | | | | Q | | | R | | | H | | | |
| D_S01763985 | | | | | | | | | | | N | | | | | | | |
| D_S01632237 | | | | | | | | | | | | | | | | | | |
| D_S01632121 | | | | | | | | | Q | | | | | | | | | |
| D_S01631557 | | | | | | | | | | | | | | | | | | |
| D_S01614407 | | | | | | | | | | | | | | | | | | |
| D_S01613034 | | | | | | | | | | N | | R | | | | | | |
| D_S01602925 | | | | | | | | | | | | R | | | | | | |
| D_S01601459 | | | | | | | | | Q | N | | | | | | | | |
| D_S01599948 | | | | | | | | | | | | | | | | | | |
| D_S01532970 | | | | | | | | | | | | | F | | | | | |
| D_S0153204 | | | | | | | | | Q | N | H | R | | | | | | |
| D_S01467003 | | | | | | | | | | | | | | | | | | |
| D_S01466770 | | | | | | | | | | | | | | | | | | |
| D_S01466712 | | | | | | | | | | | | | | | | | | |
| D_S01466681 | | | | | | | | | | | | | | | | | | |
| D_S014657862 | | | | | | | | | | | | | | E | | | | |
| D_S01457892 | | | | | | | | | | | | | | | | | | |
| D_S01443366 | | | | | | | | | | | | | | | | | | |
| D_S01442158 | | | | | | | | | | | | | | | | | | |

TABLE 5-continued

Sequence of clones of interest isolated from DNA shuffling using Cry2Ab* as parent

| | | | | | | | | | | | | | | | | | | |
|---|---|---|---|---|---|---|---|---|---|---|---|---|---|---|---|---|---|---|
| D_S01442132 | | | | | | | | | | | | | | | | | | |
| D_S-1764685 | | | | | | | | | | | | | | | | | W | |
| BY2_Cry2Ab | | | | | | | | | | N | | R | | | | | | |

| | Sample | | | | | | | | | | | | | | | | | |
|---|---|---|---|---|---|---|---|---|---|---|---|---|---|---|---|---|---|---|
| | 229 | 230 | 233 | 234 | 237 | 238 | 240 | 241 | 242 | 244 | 273 | 278 | 279 | 283 | 284 | 285 | 286 | 288 |
| Cry2Ab* | Q | S | K | G | T | R | H | D | T | E | G | A | S | P | Q | Q | T | S |
| Cry2Ab wt seq | | | | | | | | | M | | | | | | | | | |
| D_S02838648 | | | | | | | | | T | | | | | | | | | |
| D_S02838640 | | T | | | | | | | T | | | | | | | | | |
| D_S02838632 | | | | | | | | | T | | | | | | | | | |
| D_S02838470 | | | | | | | | | T | | | | | | | | | |
| D_S02838434 | | | | | | | | | T | | | | | | | | | |
| D_S02838328 | | | | | | | | | T | | | | | | | | | |
| D_S02838327 | | | | | | | | | T | | | | | | | | | |
| D_S02838310 | | T | | | | | | | T | | | | | | | | | |
| D_S01766073 | | | | | | | | | | | | | | | | | A | |
| D_S01766026 | | | | | | | | | T | | | | | | | | | |
| D_S01765621 | | | | | | | | | T | | | | | | | | | |
| D_S01765509 | | | | | | | | | T | | | | | | | | | |
| D_S01765496 | | | | | | | | | T | | | | | | | | | L |
| D_s01765255 | | | | | | | | | T | | | | | | | | | |
| D_S01765119 | | | | | | | | | T | | | | | | | | | |
| D_S01765112 | | T | R | | | | | | | | | | | | | | | |
| D_S01765104 | | | | | | | | | T | | | | | | | | | |
| D_S01765063 | | | | | | | | G | T | | | | | | | | | |
| D_S01765008 | | | | | | | | | T | | | | | | | | | |
| D_S01764977 | | | | | | | | | T | K | | | | | | | | |
| D_S01764947 | | | | | | | | | T | | | | | | | | | |
| D_S01764787 | | | | | A | | | | T | | | | | | | | | |
| D_S01764723 | | | | | | | | | T | | S | | | | | | | |
| D_S01764701 | | | | | | | | G | T | | | | | | | | | |
| D_S01764691 | | | | | | | | | T | | | | | | | | | |
| D_S01764680 | | | | | | | R | | T | | | | | | | | | |
| D_S01764668 | | | | | | | | | T | | | | | | | | | |
| D_S01764642 | | | | | | | | | T | | | | | | | | | |
| D_S01764568 | | | | | | | | | T | | | | | | | | | |
| D_S01764554 | | | | | | | | | T | | | | | | | | | |
| D_S01764546 | | | | | | | | | T | | | | | | | | | |
| D_S01764543 | | T | | | | | | | T | | | | C | | | | | |
| D_S01764533 | | | | | | | | | T | | | | | | | | | |
| D_S01764505 | | | | | | | | | T | | | | | | | | | |
| D_S01764502 | | | | | | | | G | T | | | | | | | | | |
| D_S01764500 | | | | A | | | | | T | | | T | | | | | A | |
| D_S01764196 | | | | | | G | | | T | | | | | | | | | |
| D_S01763985 | | T | | | | | | | T | | | | | V | T | N | | |
| D_S01632237 | | T | | | | | | | T | | | | | | | | | |
| D_S01632121 | | T | | | | | | | T | | | | | | | | | |
| D_S01631557 | R | | | | | | | | T | | | | | | | | | |
| D_S01614407 | | T | | | | | | | T | | | | | | | | | |
| D_S01613034 | | T | | | | | | | T | | | | | V | T | N | | |
| D_S01602925 | | T | | | | | | | T | | | | | | | | | |
| D_S01601459 | | T | | | | | | | T | | | | | | | | R | |
| D_S01599948 | | T | | | | | | | T | | | | | | | | | |
| D_S01532970 | | | | | | | | | | | | | | | | | | |
| D_S0153204 | | T | R | | | | | | T | | | | | | | | | |
| D_S01467003 | | | | | | | | | T | | | | | | | | | |
| D_S01466770 | | | | | | | | | T | | | | | | | | | |
| D_S01466712 | | | | | | | | | T | | | | R | | | | | |
| D_S01466681 | | | | | | | | | T | | | | | | | | | |
| D_S014657862 | | | | | | | | | T | | | | | | | | | |
| D_S01457892 | | | | | | | | | T | | | | | | | | | |
| D_S01443366 | | | | | | | | | T | | | | | | | | | |
| D_S01442158 | | | | | | | | | T | | | | | | | | | |
| D_S01442132 | | | | | | | | | T | | | | | | | | | |
| D_S-1764685 | | | | | | | | | | | | | | | | R | | |
| BY2_Cry2Ab | | T | | | | | | | T | | | | | | | | | |

| | Sample | | | | | | | | | | | | | | | | | |
|---|---|---|---|---|---|---|---|---|---|---|---|---|---|---|---|---|---|---|
| | 291 | 298 | 302 | 305 | 307 | 310 | 311 | 317 | 319 | 321 | 323 | 325 | 330 | 331 | 344 | 347 | 358 | 362 |
| Cry2Ab* | S | Y | Q | S | Y | N | G | L | N | F | N | V | S | T | S | I | N | N |
| Cry2Ab wt seq | | | | | | | | | | | | | | | | | | |
| D_S02838648 | | | | | | | | | | | | | | | | | | |

TABLE 5-continued

Sequence of clones of interest isolated from DNA shuffling using Cry2Ab* as parent

| Clone | 1 | 2 | 3 | 4 | 5 | 6 | 7 | 8 | 9 | 10 | 11 | 12 | 13 | 14 |
|---|---|---|---|---|---|---|---|---|---|---|---|---|---|---|
| D_S02838640 | G | | | | | | | | | | | | | |
| D_S02838632 | | | | | | | | | | | | | | |
| D_S02838470 | | H | | | | | | | | | | | | |
| D_S02838434 | | | | | | | | | | | | | | |
| D_S02838328 | | | | | | | | | G | | | | | |
| D_S02838327 | | | | | | | | | | | | | | |
| D_S02838310 | | | | | | | | | | | | | | |
| D_S01766073 | | | | | | | | | | | | | | |
| D_S01766026 | | | | | | | | | | | | | | |
| D_S01765621 | | | | | | | | | G | | | | | |
| D_S01765509 | | | | | | | | | G | | | | | |
| D_S01765496 | | | | | | | | | | | | | | |
| D_s01765255 | | | | | | | | | G | | | | V | |
| D_S01765119 | | | | | | | | | | | | | | |
| D_S01765112 | | | | | | | Q | L | G | | | | | |
| D_S01765104 | | | | | | | | | G | | | | | |
| D_S01765063 | | | | | | | | | G | | | | | |
| D_S01765008 | | | | | | | | | G | | | | | |
| D_S01764977 | | | | | | | | | | | | | | |
| D_S01764947 | | | | | | | | | | | | | | |
| D_S01764787 | | | | | | | | | G | | | | | |
| D_S01764723 | | | | | | S | | | | | | | | |
| D_S01764701 | | | | | | | | | G | | | | | |
| D_S01764691 | | | | | | | | | | | | | | |
| D_S01764680 | | | | H | | | | | G | | | | | |
| D_S01764668 | | | | | | | | | G | | | P | | |
| D_S01764642 | | | | | S | | | | | | | | | |
| D_S01764568 | | | | | | | | | | | | | | |
| D_S01764554 | | | | | | | | | | | A | | | |
| D_S01764546 | | | | | | | | | | | | | | |
| D_S01764543 | | | | | | | | | | | | | | |
| D_S01764533 | | | | | | | | | G | | | | | |
| D_S01764505 | | | Q | | | | | | G | | | | | |
| D_S01764502 | | | | S | | | | | | | | | | |
| D_S01764500 | | | | | | | | | | | | | | |
| D_S01764196 | | | | | | | | | | | | | | |
| D_S01763985 | | | | | | | | | | | | | | |
| D_S01632237 | | | | S | | | | | | | | | | |
| D_S01632121 | | | | H | | | | | | | | | | |
| D_S01631557 | | | | | | | | | | | | | | |
| D_S01614407 | | | | | | | | | | S | | | | |
| D_S01613034 | | | | | | | | | | | | | | |
| D_S01602925 | | | | | | | | | | | | | | |
| D_S01601459 | | | | | | | | | | | N | | | |
| D_S01599948 | | | | | | | | | | | | | | |
| D_S01532970 | | | | | | | | | | | T | | V | S |
| D_S0153204 | | | | | | | Q | | | | T | | | |
| D_S01467003 | | | | | | | | | | | | | | |
| D_S01466770 | | | | | | | | | | | | | | |
| D_S01466712 | | | | | | | | | | | | | | |
| D_S01466681 | | | | | | | | | | | | | | |
| D_S014657862 | | | | D | | | | | | | | | | |
| D_S01457892 | | | | | | | | | | | | | | |
| D_S01443366 | | | | | | | | | | | | | | |
| D_S01442158 | | | | | | | | | | | | | | |
| D_S01442132 | | | | | | | | | | | | | | |
| D_S-1764685 | | R | | | | | | | | | | | | S |
| BY2_Cry2Ab | | | | | | | | | | | | | | |

| Clone | 367 | 383 | 386 | 389 | 391 | 399 | 401 | 403 | 405 | 407 | 408 | 413 | 420 | 435 | 436 | 444 | 445 | 447 |
|---|---|---|---|---|---|---|---|---|---|---|---|---|---|---|---|---|---|---|
| Cry2Ab* | L | S | E | A | V | F | T | L | L | S | G | R | P | R | N | H | Y | E |
| Cry2Ab wt seq | | | | | | | | | | | | | | | | | | |
| D_S02838648 | | | | | | | | | | | | | | | | | | |
| D_S02838640 | | | | | | | | | | | | | | | | | | |
| D_S02838632 | | | | | | | | | | | | | | | | | | |
| D_S02838470 | | | | | | | | | | | | | | | | | | |
| D_S02838434 | | | | | | | | | | | | | | | | | | |
| D_S02838328 | | | | | | | | | | | | | | | | | | |
| D_S02838327 | | | | | | | | | | | | | | | | | | |
| D_S02838310 | | | | | | | | | | | | | | | | | | |
| D_S01766073 | T | | | | | | | | | | | | | | | | | |
| D_S01766026 | | | | | | | | | | | | | | | | | | |
| D_S01765621 | | | | | | | | | | | | | | | | | | |
| D_S01765509 | | | | | | | | | | | | | | | | | | |

TABLE 5-continued

Sequence of clones of interest isolated from DNA shuffling using Cry2Ab* as parent

| Clone | | | | | | | | | | |
|---|---|---|---|---|---|---|---|---|---|---|
| D_S01765496 | | | | | | | | | | |
| D_s01765255 | | | | | | | | | | |
| D_S01765119 | | | | | | | | | | |
| D_S01765112 | G | N | | | | | | | | |
| D_S01765104 | | | S | I | I | R | | | | |
| D_S01765063 | | | | | | | | | | |
| D_S01765008 | | | S | I | I | C | | | | |
| D_S01764977 | | | | | | | | | | |
| D_S01764947 | | | | | | | | | | |
| D_S01764787 | | | | | | | | | | |
| D_S01764723 | | | | | | | K | | | |
| D_S01764701 | | | | | | | | | | |
| D_S01764691 | | | | | | | | | | |
| D_S01764680 | | | | | | | | | | |
| D_S01764668 | | | S | I | I | | | | | |
| D_S01764642 | | | | | | | | | | |
| D_S01764568 | | | | | | | | | | |
| D_S01764554 | | | | | | | | | | |
| D_S01764546 | | | | | | | | | | |
| D_S01764543 | | | | | | | | | | |
| D_S01764533 | | | | | | | | | | |
| D_S01764505 | | | | | | | | Y | F | |
| D_S01764502 | | | | | | | | | | |
| D_S01764500 | | | | | | | | | | |
| D_S01764196 | | | | | | | | | | |
| D_S01763985 | | | | | | | | | | |
| D_S01632237 | | | | | | | | | | |
| D_S01632121 | | | | | | | | | | |
| D_S01631557 | | | | | | | | | | |
| D_S01614407 | | | | | | | | | | |
| D_S01613034 | | | | | | | | | | |
| D_S01602925 | | | | | | | | | | |
| D_S01601459 | | | | | | | | | | |
| D_S01599948 | | | | | | K | | | | |
| D_S01532970 | | L | | | | | | | | Q |
| D_S0153204 | G | N | | | | | | | | |
| D_S01467003 | | | | | | S | D | | | |
| D_S01466770 | | | | | | | D | | | |
| D_S01466712 | | | | | | | | | | |
| D_S01466681 | | | | | | | | | | |
| D_S014657862 | | | L | | | | | | | |
| D_S01457892 | | | | | | | | | | |
| D_S01443366 | | | | | | | | | | |
| D_S01442158 | | | | | | | | | | |
| D_S01442132 | | | | | | | | | | |
| D_S-1764685 | T | R | | | | | | | | |
| BY2_Cry2Ab | | | | | | | | | | |

| | Sample | | | | | | | | | | | | | | | | |
|---|---|---|---|---|---|---|---|---|---|---|---|---|---|---|---|---|---|
| | 448 | 459 | 461 | 476 | 490 | 491 | 492 | 497 | 498 | 500 | 508 | 513 | 517 | 529 | 530 | 537 | 538 |
| Cry2Ab* | I | G | A | H | N | D | Y | I | S | I | Q | I | F | N | N | L | R |
| Cry2Ab wt seq | | | | | | | | | | | | | | | | | |
| D_S02838648 | | | | | | | | | | | | | | | | | K |
| D_S02838640 | | | | | | | | | | | | V | | | | | |
| D_S02838632 | | | | | | | | | | | | | | | | | |
| D_S02838470 | | | | | | | | | | | | | | | | | |
| D_S02838434 | | | | | | | | | | | | | | | | | |
| D_S02838328 | | | | | | | | | | | | | | | | | |
| D_S02838327 | | | | | | | | | | | | | | | | | |
| D_S02838310 | | | | | | | | | | G | | | | | | | |
| D_S01766073 | | | | | | | | | | | | | | | | | |
| D_S01766026 | | | | | | | | | | | | | | | | | |
| D_S01765621 | | | | | | | | | V | | | | | | | | |
| D_S01765509 | | | | | | | | | | | | | | | | | |
| D_S01765496 | | | | | | | | | | | | | | | | | |
| D_s01765255 | | | | | | | | | | | | | | | | | |
| D_S01765119 | | | | | | | | | | | | | | | | | |
| D_S01765112 | | | L | Y | E | | | | | | | | | | S | | |
| D_S01765104 | | | | | | G | | | | — | | | | | | | |
| D_S01765063 | | | | | | | | | | | | | | | | | |
| D_S01765008 | | | | | | | | | | | | | | | | | G |
| D_S01764977 | | | | | | | | | | | | | | | | | |
| D_S01764947 | | | | | | | | | | | | | | | | | |
| D_S01764787 | | | | | | | | | | | | | | | | | |
| D_S01764723 | | | | | | | | | | | | | | | | | |

TABLE 5-continued

Sequence of clones of interest isolated from DNA shuffling using Cry2Ab* as parent

| | | | | | | | | | | | | | | | | | |
|---|---|---|---|---|---|---|---|---|---|---|---|---|---|---|---|---|---|
| D_S01764701 | | | | | | | | | | | | | | | | | |
| D_S01764691 | | | | | | | | | | | | | | | | | |
| D_S01764680 | | | | | | | | | | | | | | | | | |
| D_S01764668 | | | | | | | | | | | | | | | | | |
| D_S01764642 | | | | | | | | | | | | | | | | | W |
| D_S01764568 | | | | | | | | | | | | | | | | | |
| D_S01764554 | | | | | | | | | | | | | | | | | |
| D_S01764546 | T | | | | | | | | | | | | | | | | |
| D_S01764543 | | S | | | | | | | | | | | | | | | |
| D_S01764533 | | | | | | | | | | | | | | | | | |
| D_S01764505 | | | | | | | | | | | | | | | | | |
| D_S01764502 | | | | | | | | | | | | | | | | | |
| D_S01764500 | | | | | | | | | | | | | | | | | |
| D_S01764196 | | | | | | | | | | | | | | | | | |
| D_S01763985 | | | | | | | | | | | | | | | | | |
| D_S01632237 | | | | | | | | | | | | | | | | | |
| D_S01632121 | | | | | | | | | | | | | | | | | |
| D_S01631557 | | | | | | | | | | | | | | | | | |
| D_S01614407 | | | | | | | | | | R | | | | | | | |
| D_S01613034 | | | | | | | | | | | | | | | | | |
| D_S01602925 | | | | | | | | | | | | | | | | | |
| D_S01601459 | | | | | | | | | | | | | | | | | |
| D_S01599948 | | | | | | | | | | | | | | | | | |
| D_S01532970 | | | L | | E | | | | | | | | | | | | |
| D_S0153204 | | | | | | | | | | | | | | | | | |
| D_S01467003 | | | | | | | | | | | | | | | | F | |
| D_S01466770 | | | | | | | | | | | | | L | T | | F | |
| D_S01466712 | | | | | | | | | | | | | | T | | | |
| D_S01466681 | | | | | | | | | | | | | | | | | |
| D_S014657862 | | | | | | | | | | | | | | | | | |
| D_S01457892 | | | | | | G | | | | | | | | | | F | |
| D_S01443366 | | | | | | | | M | | | | | | T | | | |
| D_S01442158 | | | | | | | | | | | | | | A | | F | |
| D_S01442132 | | | | | | | | | | | | | | T | | | |
| D_S-1764685 | | | | | | | H | | | | | | | | Y | | |
| BY2_Cry2Ab | | | | | | | | | | | | | | | | | |

| | Sample | | | | | | | | | | | | | | | | |
|---|---|---|---|---|---|---|---|---|---|---|---|---|---|---|---|---|---|
| | 543 | 545 | 553 | 560 | 566 | 567 | 568 | 569 | 582 | 583 | 591 | 592 | 593 | 595 | 598 | 600 | 603 |
| Cry2Ab* | S | N | I | V | V | Y | T | A | N | D | I | N | I | N | A | S | D |
| Cry2Ab wt seq | | | | | | | | | | | | | | | | | |
| D_S02838648 | | | | | | | | | | | | | | | | | |
| D_S02838640 | | | | | | | | | | | | | | | | | |
| D_S02838632 | | | | | | | | | | | | | | | | | |
| D_S02838470 | | | | | | | | | | | | | | | | | |
| D_S02838434 | | | | | | | | | | | | | | | | | |
| D_S02838328 | | | | | | H | | | | | | | | | | | |
| D_S02838327 | | | | | | | | | | | | | | | | | |
| D_S02838310 | | | | | | | A | | | | | | | | | | |
| D_S01766073 | | | | | | | | | | | | | | | | | |
| D_S01766026 | | | | | | | | | | | | D | | | | | |
| D_S01765621 | | | | | | | | | | | | | | | | | |
| D_S01765509 | | | | | | | A | | | | | | | | | | |
| D_S01765496 | | | | | | | | | | | | | M | | | | |
| D_s01765255 | | | | | | | | | | | | | M | | | | |
| D_S01765119 | | | | | | | | | | | | | | | | | |
| D_S01765112 | | | | | | | | | | | | | | | | | |
| D_S01765104 | | | | | | | | | | | | | M | | | | |
| D_S01765063 | | | | | | | | | | | | | | | | | |
| D_S01765008 | | | | | | | | | | | | | M | | | | |
| D_S01764977 | P | | | | | | | | | | | | M | | | | |
| D_S01764947 | | | | | | | | | | | | | M | | V | | |
| D_S01764787 | | | | A | | | | | | | | | M | | | | |
| D_S01764723 | | | | | | | | | | | | | | | | | |
| D_S01764701 | | | | | | | | | | | | | | | | | |
| D_S01764691 | | | | | | | | | | | | | | | | | |
| D_S01764680 | | | | | | | | | | | | | M | | | | |
| D_S01764668 | | | | | | | | | | | | | M | | | | |
| D_S01764642 | | | | | | | | | | | | K | M | | | | |
| D_S01764568 | | | | | | | | | | | V | | M | | | | |
| D_S01764554 | | | | | | | | | | | | | | | | | |
| D_S01764546 | | | | | | | | | | | | | M | | | | |
| D_S01764543 | | | | | | | | | | | | | | | | | |
| D_S01764533 | | | | | | | | | | | | | | | | | |
| D_S01764505 | | | | | | | | | | | | | | | | | |

TABLE 5-continued

Sequence of clones of interest isolated from DNA shuffling using Cry2Ab* as parent

| Clone | | | | | | | | | | |
|---|---|---|---|---|---|---|---|---|---|---|
| D_S01764502 | | | | | | | | | | |
| D_S01764500 | | T | | | | | | | | |
| D_S01764196 | | | A | | | | | | | |
| D_S01763985 | | | | | | | | | | |
| D_S01632237 | | | | | | | | | | |
| D_S01632121 | | | | | | | | | | |
| D_S01631557 | | | | | | | | | | |
| D_S01614407 | | | | | | | | | | |
| D_S01613034 | | | | | | | | | | |
| D_S01602925 | | | | | | | | | | |
| D_S01601459 | | | | | | | | | | |
| D_S01599948 | | D | | | | | | | | |
| D_S01532970 | | | | | | | | | | |
| D_S0153204 | P | D | A | | Y | | | | | |
| D_S01467003 | | L | | | | | | | G | |
| D_S01466770 | | L | | | | | | | | N |
| D_S01466712 | | L | | | | | T | | | |
| D_S01466681 | | | | | | | | | | |
| D_S014657862 | | | | | | | | T | | |
| D_S01457892 | | | | | | | | | | |
| D_S01443366 | | L | | V | | M | | | | |
| D_S01442158 | | | | | | | | | | |
| D_S01442132 | | | | V | | M | | | | |
| D_S-1764685 | | | | N | | | | | | |
| BY2_Cry2Ab | | | | | | | | | | |

| | Sample | | | | | | | |
|---|---|---|---|---|---|---|---|---|
| | 612 | 619 | 623 | 624 | 625 | 630 | 631 | 633 |
| Cry2Ab* | L | D | I | M | L | I | S | L |
| Cry2Ab wt seq | | | | | | | | |
| D_S02838648 | | | | | | | | |
| D_S02838640 | | | | | | | | |
| D_S02838632 | | | | | | | | |
| D_S02838470 | | | | | | | | I |
| D_S02838434 | | | | | | | | |
| D_S02838328 | F | | | | | | | I |
| D_S02838327 | | | | | | | | |
| D_S02838310 | | | | | | | | |
| D_S01766073 | | | | | | | | |
| D_S01766026 | F | | | | | | | |
| D_S01765621 | | | | | | | | I |
| D_S01765509 | F | | | | | | | I |
| D_S01765496 | | | | | | | | I |
| D_s01765255 | | | | | | | | I |
| D_S01765119 | | | | | | | | |
| D_S01765112 | | | | | | | | |
| D_S01765104 | | | | | | | | |
| D_S01765063 | F | | T | | | | | |
| D_S01765008 | F | | | | | | | I |
| D_S01764977 | F | | | | | | | I |
| D_S01764947 | | | | | | | | I |
| D_S01764787 | F | | | | | | | |
| D_S01764723 | | | | | | | | |
| D_S01764701 | F | | T | | | | | |
| D_S01764691 | | | | | | | | |
| D_S01764680 | | | | | | | | I |
| D_S01764668 | | | | | | | | |
| D_S01764642 | F | | | | | | | I |
| D_S01764568 | | | | | | V | | I |
| D_S01764554 | | | | | | | | |
| D_S01764546 | | | | | | | | |
| D_S01764543 | | | | | | | | |
| D_S01764533 | | | | | | | | I |
| D_S01764505 | | | | | | | | |
| D_S01764502 | | | | | | | | |
| D_S01764500 | F | | | | | | | I |
| D_S01764196 | | | | | | | | |
| D_S01763985 | | | | | | | | |
| D_S01632237 | | | | | | | | |
| D_S01632121 | | | | | | | | |
| D_S01631557 | | | | | | | | |
| D_S01614407 | | | | | | | | |
| D_S01613034 | | | | | | | | |
| D_S01602925 | | | | | | | | |
| D_S01601459 | | | | | | | | |

TABLE 5-continued

Sequence of clones of interest isolated from DNA shuffling using Cry2Ab* as parent

| | | | | | |
|---|---|---|---|---|---|
| D_S01599948 | S | | | | |
| D_S01532970 | | | F | L | P |
| D_S0153204 | | | F | | |
| D_S01467003 | | | | | |
| D_S01466770 | | | | | I |
| D_S01466712 | F | | | | |
| D_S01466681 | | E | | | |
| D_S014657862 | | | | | |
| D_S01457892 | | | | | I |
| D_S01443366 | F | | | G | |
| D_S01442158 | | | | | |
| D_S01442132 | F | | | | I |
| D_S-1764685 | | | | | |
| BY2_Cry2Ab | | | | | |

TABLE 6

Amino acid sequence changes of clones of interest isolated from DNA shuffling using clone 44 as parent

| | Sample | | | | | | | | | | |
|---|---|---|---|---|---|---|---|---|---|---|---|
| | 64 | 143 | 149 | 189 | 192 | 216 | 217 | 225 | 228 | 290 | 345 |
| D_S00503970 (Parental Clone 44) | K | V | S | I | V | Y | T | I | Y | T | G |
| D_S01765068 | | | | | | | | | | | |
| D_S01573294 | | | | | | H | | | | | S |
| D_S01572908 | | | | A | | | | | | | |
| D_S01572905 | | | P | | | | A | | | | |
| D_S01561856 | | L | | | | | | | H | | |
| D_S01561489 | | A | | | | | | F | | | |
| D_S01561330 | | | | | | | | | | R | |
| D_S01765221 | R | | | | | | | | | | |
| D_S01561293 | R | | | | V | | | | | | |

| | Sample | | | | | | | | |
|---|---|---|---|---|---|---|---|---|---|
| | 358 | 383 | 418 | 527 | 553 | 600 | 603 | 616 | 619 | 631 |
| D_S00503970 (Parental Clone 44) | N | S | Y | E | I | S | D | T | D | P |
| D_S01765068 | | | | | | D | N | | E | S |
| D_S01573294 | | | | | | | | | | S |
| D_S01572908 | | | | | | | | | | |
| D_S01572905 | | | | | | | | | | |
| D_S01561856 | | | | | | | | A | | |
| D_S01561489 | | G | | | | | | | | |
| D_S01561330 | | | H | | | | | | | |
| D_S01765221 | D | | | G | | | | | | |
| D_S01561293 | | | | | M | | | | | |

TABLE 7

Sequence of clones of interest isolated from DNA shuffling using clone 473R as parent

| | Sample | | | | | | | | | | | | | | | | | | | | |
|---|---|---|---|---|---|---|---|---|---|---|---|---|---|---|---|---|---|---|---|---|---|
| | 4 | 12 | 17 | 29 | 31 | 32 | 34 | 38 | 51 | 93 | 96 | 108 | 124 | 137 | 139 | 140 | 141 | 142 | 143 | 144 | 147 | 153 |
| D_S01037677 (parental clone 473) | N | T | Y | H | S | L | T | E | V | D | R | T | N | N | N | R | N | A | V | P | I | T |
| D_S01765231 | | | | | | | | | | | | | | | | | | | | | | |
| D_S01764643 | | | | | P | | | | | | | | | | | | | | | | | |
| D_S01572374 | | | | | | | | | | | | | | | | | | | | | | |
| D_S01571875 | | | | | | | | | | | | | | | | | | | | | | |
| D_S01766010 | | | | | | | | | | | | | | | H | P | T | | I | S | H | |
| D_S01572168 | | | | P | | | | | | | | | | | T | Q | T | | | T | R | |
| D_S01765242 | | | | | | | | | | G | | | | | | | | | | | | |
| D_S01764953 | | | H | R | | | G | | | | | | S | | | | | | | | V | |

TABLE 7-continued

Sequence of clones of interest isolated from DNA shuffling using clone 473R as parent

| | | | | | | | | | |
|---|---|---|---|---|---|---|---|---|---|
| D_S01764728 | | | | I | A | | | | M |
| D_S01764758 | | | | | | | | | |
| D_S01571529 | S | | A | | | | | | |
| D_S01571315 | | | | | C | | | | |
| D_S01570809 | | | | | | | D | | |
| D_S01570568 | | | | | | | | | |
| D_S01570511 | A | | | | | | | | |

| | Sample | | | | | | | | | | | | | | | | | |
|---|---|---|---|---|---|---|---|---|---|---|---|---|---|---|---|---|---|---|
| | 167 | 168 | 169 | 170 | 177 | 189 | 195 | 223 | 226 | 250 | 266 | 296 | 306 | 315 | 323 | 324 | 350 | 355 |
| D_S01037677 (parental clone 473) | M | Q | G | Y | L | I | N | Y | N | F | Q | F | N | A | N | I | G | S |
| D_S01765231 | | | | | | | | | | | | | | S | | | | |
| D_S01764643 | | | | | | | | | | | | | | | | | | |
| D_S01572374 | | | | | | | | | S | | | | | | | | S | |
| D_S01571875 | | | | | | | S | | | | | | | | | | | |
| D_S01766010 | | | | | V | | | H | | S | | S | | | | | | |
| D_S01572168 | L | H | | R | | | | | | | | | | | | | | |
| D_S01765242 | L | N | N | R | | | | | | | | | | | | | | |
| D_S01764953 | L | R | | H | | | | | | | | | | | | | | |
| D_S01764728 | L | R | D | P | | | | | | | | | | | | V | | R |
| D_S01764758 | L | G | E | | | | | | | | | S | | V | | | | |
| D_S01571529 | V | E | R | | | | | | | | | | D | | | | | |
| D_S01571315 | V | G | | F | | | | | | | | | | | | | | |
| D_S01570809 | | | | | | | | | | | | | | | | | | |
| D_S01570568 | | | | | | V | | | | | | | | | | | | |
| D_S01570511 | | | | | | | | | | | | | | | | | | |

| | Sample | | | | | | | | | | | | | | | | | |
|---|---|---|---|---|---|---|---|---|---|---|---|---|---|---|---|---|---|---|
| | 356 | 357 | 358 | 362 | 372 | 378 | 384 | 390 | 425 | 434 | 446 | 447 | 451 | 455 | 474 | 479 | 492 | 504 |
| D_S01037677 (parental clone 473) | P | F | N | S | T | W | D | T | R | V | N | Q | I | S | N | H | Y | Q |
| D_S01765231 | | | | | | | | | | | | | | | | R | | |
| D_S01764643 | | | | | | | | | | | | | | | | | | |
| D_S01572374 | | | | | | | | | | | | | | | | | | |
| D_S01571875 | | | | | | | | | Q | | | | | | | H | | |
| D_S01766010 | | | | | | R | | | | | | | | P | | | | R |
| D_S01572168 | | | | | | | A | | | | | | | | | | | |
| D_S01765242 | | | | | | | G | | | | | | | | | | | |
| D_S01764953 | | | | | | | | | | | | | | | | | | |
| D_S01764728 | | | | | | | | | | | | | | | D | | | |
| D_S01764758 | T | A | G | N | S | | | | | A | | | | | | | | R |
| D_S01571529 | | | D | | | | | | | | | | T | | | | | |
| D_S01571315 | | | | | | | | | | | | | | | | | | |
| D_S01570809 | | | | | | | | | | | S | | | | | | | |
| D_S01570568 | | | | | | | | | | | | H | | | | | | |
| D_S01570511 | | | | | | | | | | | | | | | | | | |

| | Sample | | | | | | | | |
|---|---|---|---|---|---|---|---|---|---|
| | 505 | 527 | 553 | 555 | 565 | 570 | 599 | 611 | 616 | 623 |
| D_S01037677 (parental clone 473) | V | E | I | N | R | T | S | T | T | I |
| D_S01765231 | | | | | | | | | | |
| D_S01764643 | | G | | | | | | | | |
| D_S01572374 | | | | | | | | | | |
| D_S01571875 | | | | | | | | R | | |
| D_S01766010 | | | | | | | A | | | |
| D_S01572168 | | | | | | | | | | |
| D_S01765242 | | | | | | | | | | |
| D_S01764953 | A | | | | | | | | | |
| D_S01764728 | | | | | | | | | A | V |
| D_S01764758 | | | | | | | | | I | |
| D_S01571529 | | | | | | Q | | | | |
| D_S01571315 | | | | | | | | | | |
| D_S01570809 | | | | | | | | | | |
| D_S01570568 | | | | | V | | | | | |
| D_S01570511 | | | | S | | | | | | |

SEQUENCE LISTING (261 sequences)

SEQ ID NO: 1 - DNA, 1899 bp, Bacillus thuringiensis
atgcataatgtattgaatagtggaagaactactatttgtgatgcgtataatgtagtggctcatgatccatttagttttcaacataaatcattagataccatacaagaagaatggatggagtggaaaaaagataatcatagtttatatgtagatcctattgttggaactgtggctagttttcttttaaagaaagtggggagtcttgttggaaaaagaatactgagtgagttacggaatttaatatttcctagtggcagtacaaatctaatgcaagatattttaagagagacagaaaaattcctgaatcaaagacttaatacagacactcttgcccgtgtaaatgcggaattgacagggctgcaagcaaatgtagaagagtttaatcgacaagtagataattttttgaaccctaaccgaaatgctgttcctttatcaataacttcttcagttaatacaatgcagcaattatttctaaatagattaacccagttccagatgcaaggataccaattgttattattacctttatttgcacaggcagccaatttacatctttcttttattagagatgttattcttaatgcagacgaatggggaatttcagcagcaacattacgtacgtatcaaaatcacctgagaaattatacaagagattactctaattattgtataaatacgtatcaaactgcgtttagaggtttaaacacccgtttacacgatatgttagaatttagaacatatatgtttttaaatgtatttgagtatgtatctatctggtcgttgtttaaatatcaaagccttctagtctcttctggcgctaatttatatgcaagtggtagtggaccacagcagacccaatcatttacttcacaagactggccatttttatattctcttttccaagttaattcaaattatgtgttaaatggctttagtggcgctagacttacgcagactttccctaatattgttggtttacctggtactactacaactcacgcattgcttgctgcaagggtcaattacagtggaggagtttcgtctggtgatataggcgctgtgtttaatcaaaattttagttgtagcacatttctcccacctttgttaacaccatttgttaggagttggctagattcaggttcagatcggggggggatcaataccgttaccaattggcaaacagaatcctttgagacaactttaggtttaaggagtggtgcttttacagctcgaggtaattcaaactatttcccagattattttatccgtaatatttccggagttcctttagttgttagaaatgaagatttaagaagaccgttacactataatcaaataagaaatatagaaagtccttcaggaacacctggtggattacgagcttatatggtatctgtgcataacagaaaaaataatatctatgccgttcatgaaaatggtactatgattcatttagcgccggaagattatacaggatttactatatcgccgatacatgcaactcaagtgaataatcaaacgcgaacatttatttctgaaaaatttggaaatcaaggtgattccttaagatttgaacaaagcaacacgacagctcgttatacacttagagggaatggaaatagttacaatctttatttaagagtatcttcaataggaaattccactattcgagttactataaacggtagagtttatactgcttcaaatgttaatactactacaaataacgatggagttaatgataatggagctcgtttttcagatattaatattggtaatgtagtagcaagtgataatactaatgtaccgttagatataaacgtgacattaaattctggtactcaatttgagcttatgaatattatgtttgttccaactaatcttccaccactttattaa

SEQ ID NO: 2 - protein, 632 aa, Bacillus thuringiensis
MHNVLNSGRTTICDAYNVVAHDPFSFQHKSLDTIQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLTQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIVGLPGTTTTHALLAARVNYSGGVSSGDIGAVFNQNFSCSTFLPPLLTPFVRSWLDSGSDRGGINTVTNWQTESFETTLGLRSGAFTARGNSNYFPDYFIRNISGVPLVVRNEDLRRPLHYNQIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNTNVPLDINVTLNSGTQFELMNIMFVPTNLPPLY

SEQ ID NO: 3 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaacacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagtcagccttcagaggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtatcaagtggcgatattggagcttcgccgttcacccagaacttctcgtgcagcacattcctgcctcctttgcttacgccattcgttagatcctggctcgacagtggaagtgatcgagggggagttgcaactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagcttcaaacgtcaataccaccactaacaacgatggtgtaaacgacaatggtgctcgcttcagcgacatcaacatcggaaacgtagtcgcaagcgacaacagcaacgtacctctggacattaacgttacgttgaactcaggcacacagttcgaattgatgaacatcatgttcgttccgacaaacctatcaccattgtat

SEQ ID NO: 4 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLTQFQMQGYQLLLLPLFAQAANLHLSFIRDVILNADEWGISAATLRTYRNHLRNYTRDYSNYCINTYQSAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFTQNFSCSTFLPPLLTPFVRSWLDSGSDRGGVATVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNSNVPLDINVTLNSGTQFELMNIMFVPTNLSPLY

SEQ ID NO: 5 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtat

SEQ ID NO: 6 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 7 - DNA, 1905 bp, Artificial Sequence
  Description of Artificial Sequence: Synthetic sequence based on Bacillus thuringiensis
atgggacacaacgtccttaataacgaacgtaacacagtctgtgaagcacacaacgtggccgttcgcgaccctttctcattcgagcacaaatcactaaacactgttgagaaggagtggactgagtggaagagaaacgaccattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccttgcctttgtctattacgtcgtccgtcaacacgatgcagcagctattcttgaaccggttaccacaattccagatccaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 8 - protein, 634 aa, Artificial Sequence
  Description of Artificial Sequence: Synthetic sequence based on Bacillus thuringiensis
MGHNVLNNERNTVCEAHNVAVRDPFSFEHKSLNTVEKEWTEWKRNDHSLYVDPIVGTVASFLLKKVGSLVGKRILSELRSLIFPSGSTNLMQDILRETEKFLNQRLNTDTLARVNAELTGLQANVEEFNRQVDNFLNPNRNALPLSITSSVNTMQQLFLNRLPQFQIQGYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 9 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgccaatcttcacctgagcttcatcagggatgtcatcctaaatgcagacgagtggggcatatcggcagctacactacgtacttatcgaaaccatctgaggaactacacgcgtgactactcaaactactgtatcaacacctatcagtcagccttcagaggcctgaatacaaggctccacgatgtgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtatcaagtggcgatattggagcttcgccgttcacccagaacttctcgtgcagcacattcctgcctcctttgcttacgccattcgttagatcctggctcgacagtggaagtgatcgagggggagttgcaactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtat

SEQ ID NO: 10 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQSAFRGLNTRLHDVLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFTQNFSCSTFLPPLLTPFVRSWLDSGSDRGGVATVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 11 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatctcgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagtccgcattccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcacccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagcttcaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgaattgatgaacatcatgttcgttccgacaaacctatcaccattgtat

SEQ ID NO: 12 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYLDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQSAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFTQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFELMNIMFVPTNLSPLY

SEQ ID NO: 13 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagcggaagaaggacaatcattcgctatatctcgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagtccgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcacccagaacttctcgtgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagcttcaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgaattgatgaacatcatgttcgttccgacaaacctatcaccattgtat

SEQ ID NO: 14 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMERKKDNHSLYLDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTRDYSNYCINTYQSAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFTQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFELMNIMFVPTNLSPLY

SEQ ID NO: 15 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagtcagccttcagaggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtatcaagtggcgatattggagcttcgccgttcaaccagaacttcagttgcagcacattcctgcctcctttgcttacgccattcgttagatcctggctcgacagtggaagtgatcgagggggagttgcaactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagcttcaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtat

SEQ ID NO: 16 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQSAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVATVTNWQTESFETTLGLRSGAFTARGNSNYFPDYFIRNISGVPLVVRNEDLRRPLHYNQIRNIASPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASSNSDVPLDINVTLNSGTQFDLMNIMFVPTNLPPLY

SEQ ID NO: 17 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtat

SEQ ID NO: 18 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 19 - DNA, 1905 bp, Artificial Sequence
  Description of Artificial Sequence: Synthetic sequence based on Bacillus thuringiensis
atgggacattctgtccttaattccggtcgtaccacaatatgtgatgcatacaacgtggcagctcacgaccctttctcattccagcacaaatcactagacactgttcagaaagaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgagttgatgaacatcatgctggtaccgacaaacattagcccattgtattag

SEQ ID NO: 20 - protein, 634 aa, Artificial Sequence
  Description of Artificial Sequence: Synthetic sequence based on Bacillus thuringiensis
MGHSVLNSGRTTICDAYNVAAHDPFSFQHKSLDTVQKEWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFELMNIMLVPTNISPLY

SEQ ID NO: 21 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgctcaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagtactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttagggacgaagaccttcgtcgtcctctgcactacaatgagatcaggaacattgcctcgccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagctgggaaaccaaggcgattctctgaggtttgagcagacaaataccacggcaaggtacactttcaggggtaatggaaactcttacaacctatacttgcgtgtctccagccttggcaattcaactatcagggttaccatcaacggtcgagtgtacacagctacaaacgtcaataccaccaccaacaacgatggtgtaaacgacaatggtgctcgcttcagcgacatcaacatcggaaacgtagtcgcaagcagtaacagtaacgtacctctggacattaacgttacgttgaactcaggcacacagttcgatttgatgaacattatgctggtaccgacaaacattagcccaatctattag

SEQ ID NO: 22 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRDEDLRRPLHYNEIRNIASPSGTPGGARAYMVSVHNRKNNIHAVHENGSMIHLAPNDYTGFTISPIHATQVNNQTRTFISEKLGNQGDSLRFEQTNTTARYTFRGNGNSYNLYLRVSSLGNSTIRVTINGRVYTATNVNTTTNNDGVNDNGARFSDINIGNVVASSNSNVPLDINVTLNSGTQFDLMNIMLVPTNISPIY

SEQ ID NO: 23 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgcgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatatgcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccgggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacggagagtttcgagacaacactcggtctacgatcaggagcattcacagcaagaggaaacagcaactacttcccagactacttcatccgaaacatctctggagtacctctagtcgttaggaacgaagatcttcgtcgtcctctgcactacaatgagatcaggaacattgcctcaccttcaggtacacctggtggagcacgagcatacatggtctcagttcacaaccgtaagaacaacatccacgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgcacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttcaactcaggcacacagttcgatttgatgaacatcatgctggtaccgacaaacattagcccaatctattag

SEQ ID NO: 24 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANMHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVHTATNVNTTTNNDGVNDNGARFSDINIGNVVASSNSDVPLDINVTFNSGTQFDLMNIMLVPTNISPIY

SEQ ID NO: 25 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggaaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacaccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagaggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcataaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagacaaataccacggcaaggtacactctcaggggtaatggaaactcttacaacctatacttgcgtgtctccagccttggcaattcaactatcagggttaccatcaacggtcgagtgtacacagccacaaacgtcaataccaccactaacaacgatggtgtaaacgacaatggtgctcgcttcagcgacatcaacatcggaaccgtagtcgcaagcagtaacagtgacgtacctctggacattaacgttacgttcaactcaggcacacagttcgatttgatgaacatcatgctggtaccgacaaacattagcccattgtattag

SEQ ID NO: 26 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNTVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYARGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQTNTTARYTLRGNGNSYNLYLRVSSLGNSTIRVTINGRVYTATNVNTTTNNDGVNDNGARFSDINIGTVVASSNSDVPLDINVTFNSGTQFDLMNIMLVPTNISPLY

SEQ ID NO: 27 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccctgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttctcagactacttcatccgaaacatctctggagtacctctagtcgttagggatgaagaccttcgtcgtcctctgcactacaatgagatcaggaacattgcctcgccttcaggtacacctggtggagcacgagcatacatggtctcagttcacaaccgtaagaacaacatccatgcagttcatgagaacggatcaatgatccacttggctccgaacgactacaccggatttacaatcagtcctatccacgccactcaggtgaacaaccagactcgaacattcatcagtgagaagtttggaaaccaaggcgattctctgaggtttgagcagaacaatactacggcaaggtacactttcaggggtaatggaaactcttacaacctatacttgcgtgtctccagccttggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcggtaacagtgacgtacctctggacattaacgttacgttgaactcaggcacacagttcgatttgatgaacatcatgctggtaccgacaaacattagcccattgtattag

SEQ ID NO: 28 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFSDYFIRNISGVPLVVRDEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTFRGNGNSYNLYLRVSSLGNSTIRVTINGRVYTATNVNTTTNNDGVNDNGARFSDINIGNVVASGNSDVPLDINVTLNSGTQFDLMNIMLVPTNISPLY

SEQ ID NO: 29 - DNA, 1905 bp, Artificial Sequence
  Description of Artificial Sequence: Synthetic sequence based on Bacillus thuringiensis
atgggaaactccgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagcaattcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctgcactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatatcggagcttcaccattcaaccagaacttcaactgcagcacattcctgcctcctttgcttacgccattcgttagatcctggctcgacagtggaagtgatcgagaaggagtcgccactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagaccaggaacattgcctcaccttcaggtacacctggtggagcacgggcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacctgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 30 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEQFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAAALRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNETRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINMGNVVASSNSDVPLDINVTLNSGTQFDLMNIMLVPTNISPLY

SEQ ID NO: 31 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggttgctcacgaccctttctcattccagcacaaatcactagacactattcaggaagagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaacacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgacccagactttcccaaacatcgttggacttccaggaacaactacgactcatgccttgctggctgcacgagtcaactactctggtggagtatcaagtggcgatattggagctgttttcaaccagaacttctcgtgcagcacattcctgcctcctttgcttacgccattcgttagatcctggctcgacagtggaagtgatcgaggcggaattaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcaaatcaggaacattgaatcaccttcaggtacacctggtggactgcgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagtctaataccacggcaaggtacactctcaggggtaatggaaactcttacaacctatacttgcgtgtctccagcataggcaattcaactatcagggttaccatcaacggtcgagtgtacacagcttctaacgtcaataccaccactaacaacgatggtgtaaacgacaatggtgctcgcttcagcgacatcaacatcggaaacgtagtcgcaagcgacaacaccaacgtacctctggacattaacgttacgttgaactcaggcacacagttcgaattgatgaacatcatgttcgttccgacaaacctgccgccattgtattag

SEQ ID NO: 32 - protein, 633 aa, Artificial Sequence
  Description of Artificial Sequence: Synthetic sequence based on Bacillus thuringiensis
MGHNVLNSGRTTICDAYNVVAHDPFSFQHKSLDTIQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLTQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIVGLPGTTTTHALLAARVNYSGGVSSGDIGAVFNQNFSCSTFLPPLLTPFVRSWLDSGSDRGGINTVTNWQTESFETTLGLRSGAFTARGNSNYFPDYFIRNISGVPLVVRNEDLRRPLHYNQIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTASNVNTTTNNDGVNDNGARFSDINIGNVVASDNTNVPLDINVTLNSGTQFELMNIMFVPTNLPPLY

SEQ ID NO: 33 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 34 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 35 - DNA, 1905 bp, Artificial Sequence
  Description of Artificial Sequence: Synthetic sequence based on Bacillus thuringiensis
attggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcaccaacctcatgcaggatatactccgtgagaccgagaagttcctgaaccagcgactgtccacggacaccttggcacgagttaatgctgaattgaggggtctacaggcaaatgtcgaggagttcaatcaccaagttgacaacttcctaaatcccaatcgtaacgccgtgcctttgtctattacgtcgtccgtcaacacgatgcagcagctattcttgaaccggttacctatgttccagatgcaaggctaccaattgttgttactcccgttattcgcccaagctgctaatctccacctgagcttcatcagggatgtcatcctaaacgcagacgagtggggcatatcggcagctacactacgtacttatagggattacctgaaggagtacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctggacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtctcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcacaagcagtaacagtgacgtacctctggacattaacgttacgttgaactcaggcacacagttcgatttgatgaacatcatgctggtaccgacaaacattagcccattgtattag

SEQ ID NO: 36 - protein, 634 aa, Artificial Sequence
  Description of Artificial Sequence: Synthetic sequence based on Bacillus thuringiensis
IGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLSTDTLARVNAELRGLQANVEEFNHQVDNFLNPNRNAVPLSITSSVNTMQQLFLNRLPMFQMQGYQLLLLPLFAQAANLHLSFIRDVILNADEWGISAATLRTYRDYLKEYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLDGFSGARLSNTFPNIVGLPGSTTTHALLAARVNYSGGISSGDIGASPFNQNFNCSTFLPPLLTPFVRSWLDSGSDREGVATVTNWQTESLETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVTSSNSDVPLDINVTLNSGTQFDLMNIMLVPTNISPLY

SEQ ID NO: 37 - DNA, 1902 bp, Artificial Sequence; identical to SEQ ID NO: 31
  Description of Artificial Sequence: Synthetic sequence based on Bacillus thuringiensis

SEQ ID NO: 38 - protein, 633 aa, Artificial Sequence; identical to SEQ ID NO: 32
  Description of Artificial Sequence: Synthetic sequence based on Bacillus thuringiensis

SEQ ID NO: 39 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatatgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacggctacaccggatttacaatcagtcccatccacgccactcaggtgaacaaccagactcgaacattcatcagtgagaagtttggaaaccaaggcgattctctgaggtttgagcagaacaataccacggcaaggtacactttcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccaatctattag

SEQ ID NO: 40 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNGYTGFTISPIHATQVNNQTRTFISEKFGNQGDSLRFEQNNTTARYTFRGNGNSYNLYLRVSSIGNSTIRVTINGRVYTATNVNTTTNNDGVNDNGARFSDINIGNVVASSNSDVPLDINVTLNSGTQFDLMNIMLVPTNISPIY

SEQ ID NO: 41 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcatttgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcgggtacacctggtggagcacgagcatacatggtctcagttcacaaccgtaagaacaacatccatgcagttcatgagaacgggtcaatgatccacttggctccaaacgactacaccggatttacaatcagtcctatccacgccactcaggtgaacaaccagactcgaacgttcatcagtgagaagtttggaaaccaaggcgattccctgaggtttgagcaggcaaataccacggcaaggtacactttcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaacggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 42 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHLLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQANTTARYTFRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 43 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatgagtcctatccacgccactcaggtgaacaaccagactcgaacgttcatcagtgagaagtttggaaaccaaggcgattctctgaggtttgagcagacaaataccacggcaaggtacactctcaggggtaatggaaactcttacaacctatacttgcgtgtctccagccttggcaattcaactatcagggttaccatcaacggtcgagtgtacacagtgacaaacgtcaataccaccactaacaacgatggtgtaaacgacaatggtgctcgcttcagcgacatcaacatgggaaacgtagtcgcaagcagtaacagtgacgtacctctggacattaacgttacgttcaactcaggcacacagttcgatttgatgaacatcatgctggtaccgacaaacattggcccattgtattag

SEQ ID NO: 44 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTMSPIHATQVNNQTRTFISEKFGNQGDSLRFEQTNTTARYTLRGNGNSYNLYLRVSSLGNSTIRVTINGRVYTVTNVNTTTNNDGVNDNGARFSDINMGNVVASSNSDVPLDINVTFNSGTQFDLMNIMLVPTNIGPLY

SEQ ID NO: 45 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattcgctgaggtttgagcagacaaataccacggcaaggtacactctcaggggtaatggaaactcttacaacctatacttgcgtgtctccagcataggcaattcaactatcagggttaccatcaacggtcgagtgtacacagtgacaaacgtcaataccaccactaacaacgatggtgtaaacgacaatggtgctcgcttcagcgacatcaacatgggaaacgtagtcgcaagcagtaacagtgacgtacctctggacattaacgttacgttcaactcaggcacacagttcgatttgatgaacatcatgctggtaccgacaaacattagcccaatctattag

SEQ ID NO: 46 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQTNTTARYTLRGNGNSYNLYLRVSSIGNSTIRVTINGRVYTVTNVNTTTNNDGVNDNGARFSDINMGNVVASSNSDVPLDINVTFNSGTQFDLMNIMLVPTNISPIY

SEQ ID NO: 47 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggccgctcacgaccctttctcattccagcgcaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgagttgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatagggatttcctgaagaactacacgcgtgactactcaaactactgtatcaacacctatcagtccgccttcaaaggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagaaggagtcgctactctgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgcaagaacaacatccatgcagttcatgagaacggatcaatgatccacttggctccagaggactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagccacaaacgtcaataccaccactaacaacgatggtgtaaacgacaatggtgctcgcttcagcgacatcaacatcgggaacgtagtcgcaagcagcaacagcgacgtacctctggacattaacgttacgttgaactcaggcacacagttcgatttgatgaacatcatgttcgttccgacaaacctaccaccattgtattag

SEQ ID NO: 48 - protein, 634 aa, Artificial Sequence
  Description of Artificial Sequence: Synthetic sequence based on Bacillus thuringiensis
MGNSVLNSGRTTICDAYNVAAHDPFSFQRKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDFLKNYTRDYSNYCINTYQSAFKGLNTRLHDMLEFRTYMFLNVFEYVSIWSLFKYQSLLVSSGANLYASGSGPQQTQSFTSQDWPFLYSLFQVNSNYVLNGFSGARLSNTFPNIVGLPGTTTTHALLAARVNYSGGVSSGDIGASPFNQNFSCSTFLPPLLTPFVRSWLDSGSDREGVATLTNWQTESFETTLGLRSGAFTARGNSNYFPDYFIRNISGVPLVVRNEDLRRPLHYNQIRNIASPSGTPGGLRAYMVSVHNRKNNIHAVHENGSMIHLAPEDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 49 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcatcccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcggggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggaatctcaagtggcgatattggggcttcaccattcaaccagaacttcaactgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtaccactagtcgttaggaacgaagacctccgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaacccttacgacctatacttgcgtgtctccagcataggcaattcaactatcagggctaccatcaacggtcgagtgtacacagctacaaacgtcaataccaccactaacaacgatggtgtatacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacattagcccattgtattag

SEQ ID NO: 50 - protein, 634 aa, Artificial Sequence
  Description of Artificial Sequence: Synthetic sequence based on Bacillus thuringiensis
MGHNVLNSGRTTICDAYNVAAHDPFSSQHKSLDTVQREWTEWKKNNHSLYLDPIVGTVASFLLKKVGSLVGKRILSELRNLIFPSGSTNLMQDILRETEKFLNQRLNTDTLARVNAELTGLQANVGEFNRQVDNFLNPNRNAVPLSITSSVNTMQQLFLNRLPQFQMQGYQLLLLPLFAQAANLHLSFIRDVILNADEWGISAATLRTYQNHLRNYTRDYSNYCINTYQTAFRGLNTRLHDTLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGISSGDIGASPFNQNFNCSTFLPPLLTPFVRSWLDSGSDRGGVNTVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNPYDLYLRVSSIGNSTIRATINGRVYTATNVNTTTNNDGVYDNGARFSDINIGNVVASSNSDVPLDINVTLNSGTQFDLMNIMFVPTNISPLY

SEQ ID NO: 51 - DNA, 1905 bp, Artificial Sequence; identical to SEQ ID NO: 33
  Description of Artificial Sequence: Synthetic sequence based on Bacillus thuringiensis

SEQ ID NO: 52 - protein, 634 aa, Artificial Sequence; identical to SEQ ID NO: 34
  Description of Artificial Sequence: Synthetic sequence based on Bacillus thuringiensis

SEQ ID NO: 53 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaggaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcgtcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcatcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgggtcaactactctggcggagtttcaagtggcgatattggagcttcgccgttcaaccagaacttcagttgcagcacgttcctgcctcctttgcttacgccattcgttagatcctggctcgacagtggaagcgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcatgggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtattag

SEQ ID NO: 54 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLRKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFVRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSMGNSTIRVTINGRVYTATNVNTTTNNDGVNDNGARFSDINIGNVVASSNSDVPLDINVTLNSGTQFDLMNIMFVPTNLPPLY

SEQ ID NO: 55 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgcgcctttgtctattacgtcgtccgtcaacacgatgcagcagctattcttgaaccggttaccgcaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtttcaacacctatcagaccgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaggtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacattggaaacgtagtcgcaagcagcaacagcgacgtacctctggacattaacgttacgttgaactcaggcacacagttcgatttgatgaacatcatgttcgttccgacaaacctaccaccattgtattag

SEQ ID NO: 56 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAAPLSITSSVNTMQQLFLNRLPQFQMQGYQLLLLPLFAQAANLHLSFIRDVILNADEWGISAATLRTYQNHLRNYTRDYSNYCFNTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGGDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 57 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcaggagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggcggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaaccacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcctacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtggtcgcaagcagcaacagcgacgtacctctggacattaacgttacgttgaactcaggcacacagttcgatttgatgaacatcatgttcgttccaacaaacctaccaccattgtattag

SEQ ID NO: 58 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFRSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNHFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 59 - DNA, 1905 bp, Artificial Sequence
  Description of Artificial Sequence: Synthetic sequence based on Bacillus thuringiensis
atgggacacaacgtccttaattccggtcgtaccgcaatatgtgatgcatacaacgtggccgctcacgaccctttctcattccagcacaaatcactagacactgttcaggaggagtggatggagtggaagaaggacaatcattcgctatatgttgacccgatcgttgggaccgtggcttcattcttgctcaagaaggtgggctctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgacccatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcagttcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 60 - protein, 634 aa, Artificial Sequence
  Description of Artificial Sequence: Synthetic sequence based on Bacillus thuringiensis
MGHNVLNSGRTAICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGSSTIRVTINGRVYTATNVNTTTNNDGVNDNGARFSDINIGNVVASDNSNVPLDINVTLNSGTQFDLMNIMFVPTNLPPLY

SEQ ID NO: 61 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgcgagaccgagaagttcctgaaccagcgactgaacacggacaccttggcacgagttaatgctgaattgacaggtctacaggcaaatgtcgaggagttcaatcgccaagttgacaacttcctagatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggcgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacagtcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacgaacctaccaccattgtattag

SEQ ID NO: 62 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLDPNRNAVPLSITSSVNTMQQLFLNRLPQFQMQGYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYSQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 63 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcgtcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccggtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcatatcaggaacattgagtcaccttcaggtacacctggtggagcacgagcatacatggtctcagttcacaaccgtaagaacaacatctacgcagttcatgagaacggaacgatgatccacttggctccagaggactacaccggctttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcgtaggcaattcaactatcagggttaccatcaacggccgagtgtacacagctacaaacgtcaataccaccactaacaacgatggtgtaaacgacaatggtgctcgcttcagcgacatcaacatcggaaacgtagtcgcgagcgacaacagcaacgtacccctggacattaacgttacgttgaactcaggcacacagttcgatttgatgaacatcatgtttgttccgacaaacctaccaccattgtat

SEQ ID NO: 64 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFVRDVILNADEWGISAATLRTYRNHLRNYTRDYSNYCINTYQTAFRGLNTRLHDMLEFRTYMFLNVFEYVSIWSLFKYRSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNHIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSVGNSTIRVTINGRVYTATNVNTTTNNDGVNDNGARFSDINIGNVVASDNSNVPLDINVTLNSGTQFDLMNIMFVPTNLPPLY

SEQ ID NO: 65 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaaccactagacactgttcaggaggagtggatggagtggaagaaggacaatcattcgctatatgttgacccgatcgttggaaccgtggcttcattcttgctcaagaaggtgggttctctcgtcggtaagaggattctctcggaactaaggagcttgatcttcccctccggtagcacaaatctcatgcaggatatactccgtgagaccgagaagttcctgaaccagcgactgaacacggacaccttggcacgggttaatgctgaattgacaggtctacaggcaaatgtcgaggagttcaatcgccaagttgacaactttctaaatccaactcaaactgcaacgcgcttgtctattacgtcgtccgtcaacacgatgcagcagctattcttgaaccggttacctcaattccagcttcatggtcgccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcggttgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgccacctctgcttacgccattcgttagatcctggctcgacagtggaagtgatcgagggggagttaatgctgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcagaaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtat

SEQ ID NO: 66 - protein, 634 aa, Artificial Sequence
  Description of Artificial Sequence: Synthetic sequence based on Bacillus thuringiensis
MGHNVLNSGRTTICDAYNVAAHDPFSFQHKPLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPTQTATRLSITSSVNTMQQLFLNRLPQFQLHGRQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNAVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 67 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactctgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccaggtaggtggatttcaattgttgttactcccgttattcgcccaagctgctaatcttcacctgagcttcatcagggatgtcatcctaaatgcagacgagtggggcatatcggcagctacactacgtacctatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccgggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagcggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacactgagtcaccttcaggtacacctggtggagcacgagcatacatggtctcagttcacaaccgtaagaacaacatctacgcagttcatgagaacggaacgatgatccacttggctccagaggactacaccggatttacaatcagtcccatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtat

SEQ ID NO: 68 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILCETEKFLNQRLNTDTLARVNAELTGLQANVEEFNRQVDNFLNPNRNAVPLSITSSVNTMQQLFLNRLPQFQVGGFQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNTESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 69 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaagtgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccaaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggaccacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagggacaacagcaacgtacctctggacattaacgttacgttgaactcgggcacacagttcgatttgatgaacatcatgtttgttccgacaaacctaccaccattgtat

SEQ ID NO: 70 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILSADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIQNISGVPLVVRNEDLRRPLHYNQIRNIESPSGTPGGARAYMVSVHNRKNNIYAVHENGTMIHLAPEDHTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVARDNSNVPLDINVTLNSGTQFDLMNIMFVPTNLPPLY

SEQ ID NO: 71 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgagagaccgagaagttcctgaaccagcgactgaacacggacaccttggcacgagttaatgctgaattgactggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcagcacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtagcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtat

SEQ ID NO: 72 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCISTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSSDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 73 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaaaaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggcctacaggcaaatgtcgaggagttcaatcgccaagttgacaacttcctaaatcccaatcgtaacgccgtgcctttgtctattacgccgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacgcgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcgggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtat

SEQ ID NO: 74 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITPSVNTMQQLFLNRLPQFQMQGYQLLLLPLFAQAANLHLSFIRDVILNADEWGISAATLRTYQNHLRNYARDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 75 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgccatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcctcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtat

SEQ ID NO: 76 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDAILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 77 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccttgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagccacactacgtacttatcagaatcacctgcgcaactacacgcgtgactactcaaactactgtatcaacacccatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgactaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtatactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcgcacagttcgatttgatgaacatcatgttcgttccgacgaacctaccaccattgtat

SEQ ID NO: 78 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNALPLSITSSVNTMQQLFLNRLPQFQMQGYQLLLLPLFAQAANLHLSFIRDVILNADEWGISAATLRTYQNHLRNYTRDYSNYCINTHQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGAQFDLMNIMFVPTNLPPLY

SEQ ID NO: 79 - DNA, 1902 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgtcgacccgatcgttggaaccgtggcttcattcttgctcaagaaggtgggctctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgccgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaaccacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccgaacatcgttggacttccaggaacaactacgactcatgccttgctggctgcacgagtcaactactctagtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacggagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttgggaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctatcaccattgtat

SEQ ID NO: 80 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNHTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSSGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLSPLY

SEQ ID NO: 81 - DNA, 1902 bp, Artificial Sequence
  Description of Artificial Sequence: Synthetic sequence based on Bacillus thuringiensis
atgggacacagcgtccttaattccggtcgtaccacaatatgtgatgcatacaacgtggccgctcacgaccctttctcattccagcacaaatcactagacgctgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgattttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccaggtcgaaagatatcaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccgactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcgaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgattcacttggctccagaggactacaccggatttacaatcagtcctatccacgccactcgggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcaagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtat

SEQ ID NO: 82 - protein, 634 aa, Artificial Sequence
  Description of Artificial Sequence: Synthetic sequence based on Bacillus thuringiensis
MGHSVLNSGRTTICDAYNVAAHDPFSFQHKSLDAVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQVERYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSDYVLNGFSGARLSQTFPNIVGLPGTTTTHALLAARVNYSGGVSSGDIGASPFDQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATRVNNQTRTFISEKFGNQGDSLRFEQSNTTARYTLRGNGNSYNLYLRVSSIGNSTIRVTINGQVYTATNVNTTTNNDGVNDNGARFSDINIGNVVASDNSNVPLDINVTLNSGTQFDLMNIMFVPTNLPPLY

SEQ ID NO: 83 - DNA, 1902 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgggaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggactacctgaagaactacacgcgtgactactcaaactactgtatcaacacctatcagacagccttcaaaggcctgaatacaaggctccacgatacgttggagtttcggacgtacatgttcctgaacgtgttcgagtatgtctccatctggtcgcttttcaagtaccagtcattgctggtctcgtcaggtgctaacctatacgcaagtggaagtggaccacagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaaaaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacgacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgttgtcgcaagcagtaacagtgacgtacctctggacattaacgttacgtcgaactcaggcacacagttcgatttgatgaacatcatgctggtaccgacaaacattagcccattgtat

SEQ ID NO: 84 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRGTEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTAKGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYDLYLRVSSIGNSTIRVTINGRVYTATNVNTTTNNDGVNDNGARFSDINIGNVVASSNSDVPLDINVTSNSGTQFDLMNIMLVPTNISPLY

SEQ ID NO: 85 - DNA, 1902 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaagttcctgaaccagcgactgaacacggacaccttggcacgagttaatgctgaattggaaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatcagaactacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcgggtgctaacctatacgcaagtggaagtggaccacaacagagacaatcgttcacgagtcaagactggccattcctgtatagcttgttccaggtcaactccaactacgtgctgaacggcttctcaggtgctcgattgtccaacactttcccaaacatcgttggacttccaggaaacactacgactcatgccttgctggctgcacgggtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtat

SEQ ID NO: 86 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELEGLQANVEEFNRQVDNFLNPNRNAVPLSITSSVNTMQQLFLNRLPQFQMQGYQLLLLPLFAQAANLHLSFIRDVILNADEWGISAATLRTYQNYLKNYTRDYSNYCINTYQTAFKGLNTRLHDTLEFRTYMFLNVFEYVSIWSLFKYQSLLVSSGANLYASGSGPQQRQSFTSQDWPFLYSLFQVNSNYVLNGFSGARLSNTFPNIVGLPGNTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 87 - DNA, 1902 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaagttcctgaaccagcgactgaacacggacaccttggcacgagttaatgctgaattgacaggcctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggactacctgaggaactacacgcgtgactactcaaactactgtatcaacacctaccagacagccttcaaaggcctgaatacaaggctccacgatacgttggagtttcggacatacatgttcctgaacgtgttcgagtatgtctccatctggtcgcttttcaagtaccagtcattgctggtctcgtcaggtgccaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcgagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtat

SEQ ID NO: 88 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLRNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 89 - DNA, 1902 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttagaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggataccaactcttgttactcccgttattcgcccaagctgctaatcttcacctgagcttcatcagggatgtcatcctaaatgcagacgagtggggcatatcggcagctacactacgtacttataggaactacctgaggaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggagttactaatacacaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactattctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcgggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtat

SEQ ID NO: 90 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVRTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNYLRNYTRDYSNYCINTYQTAFKGLNTRLHDTLEFRTYMFLNVFEYVSIWSLFKYQSLLVSSGANLYASGSGVTNTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 91 - DNA, 1902 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgggaccgagaggttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagtttcatcagggatgtcatcctaaatgcagacgagtggggcatatcggcagctacactacgtacttatagggattacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaattccaactacgtgctgaacggcttctcaggtgctcgattgtccaacactttcccaagcatcgttggacttccaggaagcacgacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccggactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtat

SEQ ID NO: 92 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRGTERFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPSIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNRTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 93 - DNA, 1905 bp, Artificial Sequence
  Description of Artificial Sequence: Synthetic sequence based on Bacillus thuringiensis
atgggaaactctgttcttaattccggtcgtaccacaatatgtgatgcatacaacgtggcagctcacgaccctttctcattccagcacaaatcactagacactgttcagagggaatggactgagtggaagaaaaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggttatactccgtgagaccgagaagttcctgaaccagcgactgaacacggacaccttggcacgagttaatgctgaattgacaggtctacaggcaaatgtcgaggagttcaatcaccaagttgacaacttcctaaatcccaatcgtaacgccgtgcccttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcggtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 94 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQVILRETEKFLNQRLNTDTLARVNAELTGLQANVEEFNHQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYRSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 95 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgtcgtgcctttgtctattatgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttataggaactacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 96 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNVVPLSIMSSVNTMQQLFLNRLPQFQMQGYQLLLLPLFAQAANLHLSFIRDVILNADEWGISAATLRTYRNYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 97 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggatcctctcggaactaaggtccttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggctacctcaattccagatgagacaataccaactcttgttactcccgttattcgcccaagctgctaatcttcacctgagcttcatcagggatgtcatcctaaatgcagacgagtggggcatatcggcagctacactacgtacttataggaactacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgagcggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 98 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMRQYQLLLLPLFAQAANLHLSFIRDVILNADEWGISAATLRTYRNYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLSGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 99 - DNA, 1905 bp, Artificial Sequence; identical to SEQ ID NO: 95
  Description of Artificial Sequence: Synthetic sequence based on Bacillus thuringiensis

SEQ ID NO: 100 - protein, 634 aa, Artificial Sequence; identical to SEQ ID NO: 96
  Description of Artificial Sequence: Synthetic sequence based on Bacillus thuringiensis

SEQ ID NO: 101 - DNA, 1905 bp, Artificial Sequence
  Description of Artificial Sequence: Synthetic sequence based on Bacillus thuringiensis
atgggaaactctgtccttaactccggtcgtgccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaagttcctgaaccagcgactgaacacggacaccttggcacgggttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccgattacctcaattccagatgcaaggctaccaattgttgttactcccgttattcgcccaagctgctaatcttcacctgagcttcatcagggatgtcatcctaaatgcagacgagtggggcatatcggcagctacactacgtacttatcaggactacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgcacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 102 - protein, 634 aa, Artificial Sequence
  Description of Artificial Sequence: Synthetic sequence based on Bacillus thuringiensis
MGNSVLNSGRATICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQDYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLHGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 103 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggggtttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatagacaagttgacaacttcctaaatcccactcaaaacgcagtgcctttgtctattacgtcgtccgtcaacacgatgcagcagctattcttgaaccggttacctcaattccaagtgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaagccctgaatacaaggctccacgatacgttggagtttcggacatacatgttcctgaacgtgttcgagtatgtctccatctggtcgcttttcaagtaccagtcattgctggtctcgtcaggtgctaacctatacacaagtggaagtggacctcagcaagcccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcacaggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttcaactcaggcacacagttcgatttgatgaacatcatgctggtaccgacaaacattagcccaatctattag

SEQ ID NO: 104 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRGLIFPSGSTNLMQDILRETEKFLNQRLNTDTLARVNAELTGLQANVEEFNRQVDNFLNPTQNAVPLSITSSVNTMQQLFLNRLPQFQVQGYQLLLLPLFAQAANLHLSFIRDVILNADEWGISAATLRTYRDYLKNYTRDYSNYCINTYQSAFKALNTRLHDTLEFRTYMFLNVFEYVSIWSLFKYQSLLVSSGANLYTSGSGPQQAQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSTGNSTIRVTINGRVYTATNVNTTTNNDGVNDNGARFSDINIGNVVASSNSDVPLDINVTFNSGTQFDLMNIMLVPTNISPIY

SEQ ID NO: 105 - DNA, 1905 bp, Artificial Sequence
  Description of Artificial Sequence: Synthetic sequence based on Bacillus thuringiensis
atgggaaactctgtccttaattccggtcgtaccgcaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactatggggtttgatcttcccctccggtagcacaaatctcatgcaggatatactccgtgagaccgagcaattcctgaaccagcgactgaacacggacaccttggcacgagttaatgctgaattgacaggtctacgggcaaatgtcgaggagttcaatcgccaagttgacaacttcctaaatcccaatcaaaacgcagtgcctttgtctattacgtcgtccgtcaacacgatgcagcagctattcttgaaccggttacctcaattccagatgcaaggctaccaattgttgttactcccgttattcgcccaagctgctaatcttcacttgggcttcatcagggatgtcgtcctaaatgcagacgagtggggcatatcggcagctgcactacgtacttatagggattacctgaagaactacacgcgtgactactcaaactactgtatcaacacctatcagtccgccttcaaaggcctgaatacaagactccacggtacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgagcggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 106 - protein, 634 aa, Artificial Sequence
  Description of Artificial Sequence: Synthetic sequence based on Bacillus thuringiensis
MGNSVLNSGRTAICDAYNVAAHDPFSFQHKSLDTVQREWTEWKKNNHSLYLDPIVGTVASFLLKKVGSLVGKRILSELWGLIFPSGSTNLMQDILRETEQFLNQRLNTDTLARVNAELTGLRANVEEFNRQVDNFLNPNQNAVPLSITSSVNTMQQLFLNRLPQFQMQGYQLLLLPLFAQAANLHLGFIRDVVLNADEWGISAAALRTYRDYLKNYTRDYSNYCINTYQSAFKGLNTRLHGTLEFRTYMFLNVFEYVSIWSLFKYQSLLVSSGANLYASGSGPQQTQSFTSQDWPFLYSLFQVNSNYVLSGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 107 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggttgctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacagtcaaatgtcgaggagttcaatcgccaagttgacaacttcctaaaccccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaaccaaaactacgtgctgaacggcttctcaggtgctcgattgtccaacactttcccaaacatcggtggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctggtcgttaggaacgaagaccttcgtcgtcctctgtacttcaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcccatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 108 - protein, 634 aa, Artificial Sequence
  Description of Artificial Sequence: Synthetic sequence based on Bacillus thuringiensis
MGHNVLNSGRTTICDAYNVVAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQSNVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNQNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLYFNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 109 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactatggaatttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccactagaaacgcagtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcgtcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggaatctcaagtggcgatattggagcctcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacgctcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcggacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccaatctattag

SEQ ID NO: 110 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELWNLIFPSGSTNLMQDILRETEKFLNQRLNTDTLARVNAELTGLQANVEEFNRQVDNFLNPTRNAVPLSITSSVNTMQQLFLNRLPQFQMQGYQLLLLPLFAQAANLHLSFIRDVVLNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPIY

SEQ ID NO: 111 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcgagaaggtgggttctctcgttggtaagaggattctctcggaactaaggtccttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcatgtggaagtggacctcagcaaacccaatcgttcacgagtcaagactggccattcctgtatagcttgtttcaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctagtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctagtaccgacaaacattagcccattgtattag

SEQ ID NO: 112 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLEKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQTAFKGLNTRLHDTLEFRTYMFLNVFEYVSIWSLFKYQSLLVSSGANLYACGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPSGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 113 - DNA, 1905 bp, Artificial Sequence; identical to SEQ ID NO: 29
  Description of Artificial Sequence: Synthetic sequence based on Bacillus thuringiensis

SEQ ID NO: 114 - protein, 634 aa, Artificial Sequence; identical to SEQ ID NO: 30
  Description of Artificial Sequence: Synthetic sequence based on Bacillus thuringiensis

SEQ ID NO: 115 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaggttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgccatcctaaatgcagacgagtggggcatatcggcagccacactacgtacttatcaggactacctgaagaactacacgcgtgactactcaaactactgtatcagcacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcgggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccgggaagcgctacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacccctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 116 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETERFLNQRLNTDTLARVNAELTGLQANVEEFNRQVDNFLNPNRNAVPLSITSSVNTMQQLFLNRLPQFQMQGYQLLLLPLFAQAANLHLSFIRDAILNADEWGISAATLRTYQDYLKNYTRDYSNYCISTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSATTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 117 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgtcggaaccgtggcttcattcttgctcaagaaggtcggttctctcgtcggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaggtatcgaggagttcaatagacaagttgacaacttcctaaatcccaatcgtaacgcagtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcccatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacgtcaacatgggaaacgtagtcgcaagcagtaacagtgacgtacctctggacattaacgttacgttgaactcaggcacacagttcgatttgatgaacatcgtgctggtaccgacaaacattagcccaatctattag

SEQ ID NO: 118 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQAGIEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDVNMGNVVASSNSDVPLDINVTLNSGTQFDLMNIVLVPTNISPIY

SEQ ID NO: 119 - DNA, 1905 bp, Artificial Sequence; identical to SEQ ID NO: 33
  Description of Artificial Sequence: Synthetic sequence based on Bacillus thuringiensis

SEQ ID NO: 120 - protein, 634 aa, Artificial Sequence; identical to SEQ ID NO: 34
  Description of Artificial Sequence: Synthetic sequence based on Bacillus thuringiensis

SEQ ID NO: 121 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccattgtattag

SEQ ID NO: 122 - protein, 634 aa, Artificial Sequence; identical to SEQ ID NO: 6
  Description of Artificial Sequence: Synthetic sequence based on Bacillus thuringiensis

SEQ ID NO: 123 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctcttggaactaaggaacttgatcttcccctccggtagcacaaatctcatgcaggatatactccgtgagaccgagcaattcctgaaccagcgactgaacacggacaccttggcacgagttaatgctgaattgacaggtctacaggcaaatgtcgaggagttcaatagacaagttgacaacttcctaaatcccaatcgtaacgccgtgcctttgtctattacgtcgtccgtcaacacgatgcagcagctattcttgaaccggttacctcaattccaagtgcaaggctaccaattgttgttactcccgttattcgcccaagctgctaatatgcacctgagcttcatcagggatgtcgtcctaaatgcagacgagtggggcatatcggcagctacactacgtacttatagggattacctgaagaactacacgagggaatactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacagcttctcaggtgctcgattgtccaacactttcccaaacatcgttggacttccaggaagcactacgactcacgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctctggggtaatggaaactcttacaacctatacttgcgtgtctccagcataggcaattcaactatcagggttaccatcaacggtcgagtgtacacagctacaaacgtcaataccaccactaacaacgacggtgtaaacgacaatggtgctcgtttcagcgacatcaaaatgggaaacgtagtcgcaagcagtaacagtgacgtacctctggacattaacgttacgttcaactcaggcacacagttcgatttgatgaacatcatgctggtaccaacaaacattagcccaatctattag

SEQ ID NO: 124 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILLELRNLIFPSGSTNLMQDILRETEQFLNQRLNTDTLARVNAELTGLQANVEEFNRQVDNFLNPNRNAVPLSITSSVNTMQQLFLNRLPQFQVQGYQLLLLPLFAQAANMHLSFIRDVVLNADEWGISAATLRTYRDYLKNYTREYSNYCINTYQSAFKGLNTRLHDTLEFRTYMFLNVFEYVSIWSLFKYQSLLVSSGANLYASGSGPQQTQSFTSQDWPFLYSLFQVNSNYVLNSFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLWGNGNSYNLYLRVSSIGNSTIRVTINGRVYTATNVNTTTNNDGVNDNGARFSDIKMGNVVASSNSDVPLDINVTFNSGTQFDLMNIMLVPTNISPIY

SEQ ID NO: 125 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcaccagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctctggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacgctcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgggcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 126 - protein, 634 aa, Artificial Sequence
  Description of Artificial Sequence: Synthetic sequence based on Bacillus thuringiensis
MGHNVLNSGRTTICDAYNVAAHDPFSFQHKSPDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFGQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 127 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgacccttcctcattccagcacaaatcactagactctgttcagagggaatggactgagtggaagaagaacaatcattcgctatatctcgacccgatcgttggaaccgtggcttcattcttgctcaagaaggtcggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggcctacaggcaaatgtcgaggagttcaatcgccaagttgacaacttcctaaatcccaatagaaacgcagtgcctttgtctattacgtcgtccgtcaacacgatgcagcagctattcttgaaccggttacctcaattcagaatgcaaggctaccaattgttgttactcccgttattcgcccaagctgctaatatgcacctgagcttcatcagggatgtcgtcctaaatgcagacgagtggggcatatcggcagctacactacgtacttatagggattacctgaagaactacacgcgtgactactcaaactactgtatcaacacctatcagtccgccttcaaaggcctgaatacaaggctccgcgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaaccacgtgctgaacggcttctcaggtgctcgattgtccaacactttcccaaacatcggtggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggcctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttgaactcaggcacacagttcgatttgatgaacatcatgctggtaccgacaaacattagcccaatctattag

SEQ ID NO: 128 - protein, 634 aa, Artificial Sequence
  Description of Artificial Sequence: Synthetic sequence based on Bacillus thuringiensis
MGNSVLNSGRTTICDAYNVAAHDPSSFQHKSLDSVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFRMQGYQLLLLPLFAQAANMHLSFIRDVVLNADEWGISAATLRTYRDYLKNYTRDYSNYCINTYQSAFKGLNTRLRDTLEFRTYMFLNVFEYVSIWSLFKYQSLLVSSGANLYASGSGPQQTQSFTSQDWPFLYSLFQVNSNHVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINMGNVVASSNSDVPLDINVTLNSGTQFDLMNIMLVPTNISPIY

SEQ ID NO: 129 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactggaactactgtatcaacacctatcagtccgccttcaaaggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcgaacccaatcgttcacgagtcaagactggccattcctgtatagcttgttccgggtcaactccaactacgtgctgaacggcttctcaggtgctcgattgtccaacactttcccaaacatcgttggacttccaggaagcactacgactcatgccttgctggctgcacgggtcaactactctggcggaatctcaagtggcgatattggagcttcaccattcagccagaactttaactgcagcacattcacccctcctttgcttacgccattcgttagatcctggctcgacagtggacgtgaccgagaaggtgtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgaccacaccggatttacaatcagtcctatccacgccactcaggtgaacaaccagactcgaacgttcatcagtgagaagtttggaaaccaaggcgattctctgaggtttgagcagaactataccacggcaaggtacactctcaggggtaatggaaactcttacaacctatacctgcgtgtctccagcataggcaattcaactatcagggttaccatcaacggtcgagtgtacacagctacaaacgtcaataccaccactaacaacgatggtgtaaacaacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 130 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYWNYCINTYQSAFKGLNTRLHDMLEFRTYMFLNVFEYVSIWSLFKYQSLLVSSGANLYASGSGPQRTQSFTSQDWPFLYSLFRVNSNYVLNGFSGARLSNTFPNIVGLPGSTTTHALLAARVNYSGGISSGDIGASPFSQNFNCSTFTPPLLTPFVRSWLDSGRDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDHTGFTISPIHATQVNNQTRTFISEKFGNQGDSLRFEQNYTTARYTLRGNGNSYNLYLRVSSIGNSTIRVTINGRVYTATNVNTTTNNDGVNNNGARFSDINIGNVVASSNSDVPLDINVTLNSGTQFDLMNIMLVPTNISPLY

SEQ ID NO: 131 - DNA, 1905 bp, Artificial Sequence; identical to SEQ ID NO: 33
  Description of Artificial Sequence: Synthetic sequence based on Bacillus thuringiensis

SEQ ID NO: 132 - protein, 634 aa, Artificial Sequence; identical to SEQ ID NO: 34
  Description of Artificial Sequence: Synthetic sequence based on Bacillus thuringiensis

SEQ ID NO: 133 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgtcggaaccgtggcttcattcttgctcaagaaggtgggttctctcgttggtaagaggattctctcggaactaaggaatttgatcttcccctccggtagcacaaatctcatgcaggatatactccgtgagaccgagcaattcctgaaccagcgactggacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctgaatgcagacgagtggggcatatcggcagctacactacgtacttatagggattacctgaagaactacacgcgtgactactcaaactactgtatcaacacctatcagtccgccttcaaaggcctgaatacaaggctccacggtacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccctgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcattcgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttcaactcaggcacacagttcgatttgatgaacaccatgctggtaccgacaaacattagcccattgtattag

SEQ ID NO: 134 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEQFLNQRLDTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHGTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTFNSGTQFDLMNTMLVPTNISPLY

SEQ ID NO: 135 - DNA, 1905 bp, Artificial Sequence; identical to SEQ ID NO: 33
  Description of Artificial Sequence: Synthetic sequence based on Bacillus thuringiensis

SEQ ID NO: 136 - protein, 634 aa, Artificial Sequence; identical to SEQ ID NO: 34
  Description of Artificial Sequence: Synthetic sequence based on Bacillus thuringiensis

SEQ ID NO: 137 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttcttattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactatggggcttgatcttcccctccggtagcacaaatctcatgcaggatatactccgtgagaccgagaagttcctgaaccagcgactgaacacggacaccttggcacgagttaatgctgaaatgacaggtctacaggcaaatgtcgaggagttcaatcgccaagttgacaacttcctaaatcccaatcaaaacgcagtgcctttgtctattacgtcgtccgtcaacacgttgcagcagctattcttgaaccggttacctcaattcagagtgcaaggctaccaattgttgttactcccgttattcgcccaagctgctaatcttcacctgagcttcatcagggatgtcgtcctaaatgcggacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaagtgctaacctatacgcaagtggaagtggacctcagcaaacccaatcgttcacgagtcaagactggccattcctgtatagcttgttccaggtcaactccaactacgtgctgaacggcttctcaggtgcccgatcgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaagaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 138 - protein, 634 aa, Artificial Sequence
  Description of Artificial Sequence: Synthetic sequence based on Bacillus thuringiensis
MGNSVLNSGRTTICDAYNVAAHDPFLFQHKSLDTVQREWTEWKKNNHSLYLDPIVGTVASFLLKKVGSLVGKRILSELWGLIFPSGSTNLMQDILRETEKFLNQRLNTDTLARVNAEMTGLQANVEEFNRQVDNFLNPNQNAVPLSITSSVNTLQQLFLNRLPQFRVQGYQLLLLPLFAQAANLHLSFIRDVVLNADEWGISAATLRTYRDYLKNYTRDYSNYCINTYQSAFKGLNTRLHDTLEFRTYMFLNVFEYVSIWSLFKYQSLLVSSSANLYASGSGPQQTQSFTSQDWPFLYSLFQVNSNYVLNGFSGARSSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVKNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 139 - DNA, 1905 bp, Artificial Sequence
  Description of Artificial Sequence: Synthetic sequence based on Bacillus thuringiensis
atggggaactctgtccttaattccggtcgtaccacaatatgtgatgcatacgacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcattggtaagaggattctctcggaactaaggaacttgatcttcccctccggtagcacaaatctcatgcaggatatactccgtgagaccgagaagttcctgaaccagcgactgaacacggacaccttggcgcgtgttaatgctgaattggaaggtctacaggcaaatgtcgaggagttcaatcgccaagttgacaacttcctaaatccccctagaagggccgtgcacttgtctattacgtcgtccgtcaacacgatgcagcagctattcttgaaccggttacctcaattccagatgcaaggctaccaattgttgttactcccgttattcgcccaagcggctaatcttcacctgagcttcatcagggatgtcatcctaaatgcaggcgagtggggcatatcggcagctacactacgtacttatcaggactacctgaagaactacacgcgtgactactcaaactactgcatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactatgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcctcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 140 - protein, 634 aa, Artificial Sequence
  Description of Artificial Sequence: Synthetic sequence based on Bacillus thuringiensis
MGNSVLNSGRTTICDAYDVAAHDPFSFQHKSLDTVQREWTEWKKNNHSLYLDPIVGTVASFLLKKVGSLIGKRILSELRNLIFPSGSTNLMQDILRETEKFLNQRLNTDTLARVNAELEGLQANVEEFNRQVDNFLNPPRRAVHLSITSSVNTMQQLFLNRLPQFQMQGYQLLLLPLFAQAANLHLSFIRDVILNAGEWGISAATLRTYQDYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTMTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARLSDINIGNVVASSNSDVPLDINVTLNSGTQFDLMNIMLVPTNISPLY

SEQ ID NO: 141 - DNA, 1905 bp, Artificial Sequence
  Description of Artificial Sequence: Synthetic sequence based on Bacillus thuringiensis
atgggacacaacgtccttaattccggtcgtaccacaatatgtgatgcatataacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatgggaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 142 - protein, 634 aa, Artificial Sequence; identical to SEQ ID NO: 18
  Description of Artificial Sequence: Synthetic sequence based on Bacillus thuringiensis

SEQ ID NO: 143 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgaattgatgaacatcatgttcgttccgacaaacctatcaccattgtattag

SEQ ID NO: 144 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFELMNIMFVPTNLSPLY

SEQ ID NO: 145 - DNA, 1905 bp, Artificial Sequence
  Description of Artificial Sequence: Synthetic sequence based on Bacillus thuringiensis
atgggacacaacgtccttaattccggtcgtaccacaatatgtgatgcatataacgtggccgctcacgaccctttttcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatgggaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 146 - protein, 634 aa, Artificial Sequence; identical to SEQ ID NO: 18
  Description of Artificial Sequence: Synthetic sequence based on Bacillus thuringiensis

SEQ ID NO: 147 - DNA, 1905 bp, Artificial Sequence; identical to SEQ ID NO: 133
  Description of Artificial Sequence: Synthetic sequence based on Bacillus thuringiensis

SEQ ID NO: 148 - protein, 634 aa, Artificial Sequence; identical to SEQ ID NO: 134
  Description of Artificial Sequence: Synthetic sequence based on Bacillus thuringiensis

SEQ ID NO: 149 - DNA, 1905 bp, Artificial Sequence
  Description of Artificial Sequence: Synthetic sequence based on Bacillus thuringiensis
atgggaaactctgtccttaattccggtcgcaccacaatatgcgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagcaattcctgaaccagcgactgaacacggacaccttggcacgagttaatgctgaattgacaggtctacaggcaaatgtcgaggagttcaatcgccaagttgacaacttcctaaatcccaatcgtaacgccgtgcttttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacggagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 150 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEQFLNQRLNTDTLARVNAELTGLQANVEEFNRQVDNFLNPNRNAVLLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 151 - DNA, 1905 bp, Artificial Sequence
  Description of Artificial Sequence: Synthetic sequence based on Bacillus thuringiensis
atgggaaactctgtccttaattccggtcataccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctcttgttggtaagaggattctctcggaactaaggaatttgatcttcccctccggtagcacaaatctcatgcaggatatactccatgagaccgagaagttcctgaaccagcgactgaacacggacacctgggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggtcacctcaattccagatgcaaggctaccaattgttgttactcccgttattcgcccaagctgctaatatgcacctgagcttcatcagggaagtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcagacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagtcaacaattggtattcgatccagagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacggctacaccggatttacaatcagtcctatccacgccactcaggtgaacaactagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 152 - protein, 633 aa, Artificial Sequence
  Description of Artificial Sequence: Synthetic sequence based on Bacillus thuringiensis
MGNSVLNSGHTTICDAYNVAAHDPFSFQHKSLDTVQREWTEWKKNNHSLYLDPIVGTVASFLLKKVGSLVGKRILSELRNLIFPSGSTNLMQDILHETEKFLNQRLNTDTWARVNAELTGLQANVEEFNRQVDNFLNPNRNAVPLSITSSVNTMQQLFLNRSPQFQMQGYQLLLLPLFAQAANMHLSFIREVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFESTIGIRSRAFTARGNSNYFPDYFIRNISGVPLVVRNEDLRRPLHYNEIRNIASPSGTPGGARAYMVSVHNRKNNIHAVHENGSMIHLAPNGYTGFTISPIHATQVNNTRTFISEKFGNQGDSLRFEQNNTTARYTLRGNGNSYNLYLRVSSIGNSTIRVTINGRVYTATNVNTTTNNDGVNDNGARFSDINMGNVVASSNSDVPLDINVTLNSGTQFDLMNIMLVPTNISPLY

SEQ ID NO: 153 - DNA, 1905 bp, Artificial Sequence
  Description of Artificial Sequence: Synthetic sequence based on Bacillus thuringiensis
atgggaaactctgtccttaattccggtcgtaccacaacacgtgatgcatacaacgtggccgctcacgaccctttctcattccagcacaaatcactagacactgttcagagggaatggactgagtggaagaagaacaatcattcgctatatgttgacccggtcgttggaaccgtggcttcattcttgctcaagaaggtgggttctctcgttggtaagaggattctctcggaactaaggaacttgatcttcccctccggtagcacagatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgcaacgccgtgcctttgtctattacgtcgtccgtcaacgcgatgcagcagctattcttgaaccggttaccacaattccagatgcaaggctaccagttgttgttactcccgttattcgcccaagctgctaatcttcacctgagcttcatcagggatgtcatcctaaatgcagacgagtggggcatatcggcagctacactacgtacttatcagaatcacttgcgcaactacacgcgtgactactcaaactactgtatcaacacctatcagactgccttccgtggcctgaatacaaggctccacgatatgctggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactctcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggattgcgagcatacatggtctcagttcacaaccgtaagaacaacatctacgcagttcatgagaacggatccatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaacggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 154 - protein, 634 aa, Artificial Sequence
  Description of Artificial Sequence: Synthetic sequence based on Bacillus thuringiensis
MGNSVLNSGRTTTRDAYNVAAHDPFSFQHKSLDTVQREWTEWKKNNHSLYVDPVVGTVASFLLKKVGSLVGKRILSELRNLIFPSGSTDLMQDILRETEKFLNQRLNTDTLARVNAELTGLQANVEEFNRQVDNFLNPNRNAVPLSITSSVNAMQQLFLNRLPQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTLPNIVGLPGSTTTHALLAARVNYSGGISSGDIGASPFNQNFNCSTFLPPLLTPFVRSWLDSGSDRGGVNTVTNWQTESFETTLGLRSGAFTARGNSNYFPDYFIRNISGVPLVVRNEDLRRPLHYNEIRNIASPSGTPGGLRAYMVSVHNRKNNIYAVHENGSMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 155 - DNA, 1905 bp, Artificial Sequence; identical to SEQ ID NO: 121
  Description of Artificial Sequence: Synthetic sequence based on Bacillus thuringiensis

SEQ ID NO: 156 - protein, 634 aa, Artificial Sequence; identical to SEQ ID NO: 6
  Description of Artificial Sequence: Synthetic sequence based on Bacillus thuringiensis

SEQ ID NO: 157 - DNA, 1905 bp, Artificial Sequence
  Description of Artificial Sequence: Synthetic sequence based on Bacillus thuringiensis
atgggacacaacgtccttaattccggtcgcaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcagggtatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcccttgtctattacgtcgtccgtcaacacgatgcagcagctattcttgaaccggttacctcaattccagctgaataatcgtcaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccaaactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtggtcgagggggagttaatactgtgaccaactggcagacagagagtttcgagacaacactcggtctacgatcaggagcattcacagcaagaggaaacagcaactacttcccagactacttcatccgaaacatctctggagtacccctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggtgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 158 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQGILRETEKFLNQRLNTDTLARVNAELTGLQANVEEFNRQVDNFLNPNRNAVPLSITSSVNTMQQLFLNRLPQFQLNNRQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSGRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 159 - DNA, 1905 bp, Artificial Sequence; identical to SEQ ID NO: 149
  Description of Artificial Sequence: Synthetic sequence based on Bacillus thuringiensis

SEQ ID NO: 160 - protein, 634 aa, Artificial Sequence; identical to SEQ ID NO: 150
  Description of Artificial Sequence: Synthetic sequence based on Bacillus thuringiensis

SEQ ID NO: 161 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaggaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcagaatcacctgcgcaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgttggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcgaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgcgtcaccttcaggtacacctggtggattgcgagcatacatggtctcagttcacaaccgtaagaacaacatctacgcagttcatgagaacggatccatgatccacttagctccagaggactacaccggatttacaatcagtcctatccacgccactcaggtgaacaaccagactcgaacgttcatcagtgagaagtttggaaaccaaggcgattctctgaggtttgggcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagcaacagcgacgtacctctggacattaacgttacgttgaactcaggcacacagttcgatttgatgaacatcatgttcgttccgacaaacctaccaccgttgtattag

SEQ ID NO: 162 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLRKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFDQNFSCSTFLPPLLTPFVRSWLDSGSDRGGVNTVTNWQTESFETTLGLRSGAFTARGNSNYFPDYFIRNISGVPLVVRNEDLRRPLHYNQIRNIASPSGTPGGLRAYMVSVHNRKNNIYAVHENGSMIHLAPEDYTGFTISPIHATQVNNQTRTFISEKFGNQGDSLRFGQSNTTARYTLRGNGNSYNLYLRVSSIGNSTIRVTINGRVYTATNVNTTTNNDGVNDNGARFSDINIGNVVASSNSDVPLDINVTLNSGTQFDLMNIMFVPTNLPPLY

SEQ ID NO: 163 - DNA, 1905 bp, Artificial Sequence; identical to SEQ ID NO: 33
  Description of Artificial Sequence: Synthetic sequence based on Bacillus thuringiensis

SEQ ID NO: 164 - protein, 634 aa, Artificial Sequence; identical to SEQ ID NO: 34
  Description of Artificial Sequence: Synthetic sequence based on Bacillus thuringiensis

SEQ ID NO: 165 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgccgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaagcatcgttggacttccaggaacaactacgactcatgccttgctggctgcacgagtcaactactctggtggagtttcaagtggcgatattggagcctcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcgtgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgacttgatgaacatcatgtttgttccgacaaacctaccaccattgtattag

SEQ ID NO: 166 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPSIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVRENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 167 - DNA, 1905 bp, Artificial Sequence
  Description of Artificial Sequence: Synthetic sequence based on Bacillus thuringiensis
atgggaaactctgtccttaattccggtcgtaccacaatatgtgacgcatacaacgtggcagctcacgaccctttctcattccggcacaaatcactagacactgttcagagggaatggactgagtggaagaagaacaatcattcgctatatctcgacccgatcgttggaaccgtggcttcgttcttgctcaagaaggtcggttctctcgtcggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcaacaagttgacaacttcctaaatcccaatcgcaacgccgtgcctttgtctattacgtcgtccgtcaacacgatgcagcagctattcttgaaccggttacctcaattccaagtgcaaggctaccaattgttgttactcccgttattcgcccaagctgctaatatgcacctgagcttcatcagggatgtcgtcctaaatgcagacgagtggggcatatcggcagctacactacgtacttatagggattacctgaagaactacacgagggactactcaaactactgtatcaacacctatcagtccgccttcaaaggcctgaatacaaggctccacgacacgttggagtttcggacatacatgttcctgaacgtgttcgaatatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggagtctcaagcggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttgaactcaggcacacagttcgatttgatgaacatcatgctggtaccgacaaacattagcccaatctattag

SEQ ID NO: 168 - protein, 634 aa, Artificial Sequence
  Description of Artificial Sequence: Synthetic sequence based on Bacillus thuringiensis
MGNSVLNSGRTTICDAYNVAAHDPFSFRHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNQQVDNFLNPNRNAVPLSITSSVNTMQQLFLNRLPQFQVQGYQLLLLPLFAQAANMHLSFIRDVVLNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGVSSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINMGNVVASSNSDVPLDINVTLNSGTQFDLMNIMLVPTNISPIY

SEQ ID NO: 169 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcaccagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctctggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccacaattccagatgcaaggctaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacgctcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgggcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcgacaacagcaacgtacctctggacattaacgttacgttgaactcaggcacacagttcgatttgatgaacatcatgtttgttccgacaaacctaccaccattgtattag

SEQ ID NO: 170 - protein, 634 aa, Artificial Sequence; identical to SEQ ID NO: 126
  Description of Artificial Sequence: Synthetic sequence based on Bacillus thuringiensis

SEQ ID NO: 171 - DNA, 1905 bp, Artificial Sequence; identical to SEQ ID NO: 121
  Description of Artificial Sequence: Synthetic sequence based on Bacillus thuringiensis

SEQ ID NO: 172 - protein, 634 aa, Artificial Sequence; identical to SEQ ID NO: 6
  Description of Artificial Sequence: Synthetic sequence based on Bacillus thuringiensis

SEQ ID NO: 173 - DNA, 1905 bp, Artificial Sequence; identical to SEQ ID NO: 141
  Description of Artificial Sequence: Synthetic sequence based on Bacillus thuringiensis

SEQ ID NO: 174 - protein, 634 aa, Artificial Sequence; identical to SEQ ID NO: 18
  Description of Artificial Sequence: Synthetic sequence based on Bacillus thuringiensis

SEQ ID NO: 175 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccggcacaaatcactagacactgttcagagggaatggactgagtggaagaagaacaatcattcgctatatctcgacccgatcgttggaaccgtggcttcattcttgctcaagaaggtgggttctctcatcggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgacaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaattgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttgaactcaggcacacagttcgatttgatgaacatcatgctggtaccgacaaacattagcccaatctattag

SEQ ID NO: 176 - protein, 634 aa, Artificial Sequence
  Description of Artificial Sequence: Synthetic sequence based on Bacillus thuringiensis
MGNSVLNSGRTTICDAYNVAAHDPFSFRHKSLDTVQREWTEWKKNNHSLYLDPIVGTVASFLLKKVGSLIGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQLFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINMGNVVASSNSDVPLDINVTLNSGTQFDLMNIMLVPTNISPIY

SEQ ID NO: 177 - DNA, 1905 bp, Artificial Sequence; identical to SEQ ID NO: 123
  Description of Artificial Sequence: Synthetic sequence based on Bacillus thuringiensis

SEQ ID NO: 178 - protein, 634 aa, Artificial Sequence; identical to SEQ ID NO: 124
  Description of Artificial Sequence: Synthetic sequence based on Bacillus thuringiensis

SEQ ID NO: 179 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttcttattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaagagtttgatcttcccctccggtagcacaaatctcatgcaggatatactccgtgagaccgagcaattcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccaaatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgagggactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacggtcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccacccaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgtaagcagtaacagtgacgtacctctggacattaacgttacgttgaactcaggcacacagttcgatttgatgaacatcatgctggtaccgacaaacattagcccaatctattag

SEQ ID NO: 180 - protein, 634 aa, Artificial Sequence
  Description of Artificial Sequence: Synthetic sequence based on Bacillus thuringiensis
MGNSVLNSGRTTICDAYNVAAHDPFLFQHKSLDTVQREWTEWKKNNHSLYLDPIVGTVASFLLKKVGSLVGKRILSELKSLIFPSGSTNLMQDILRETEQFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINMGNVVVSSNSDVPLDINVTLNSGTQFDLMNIMLVPTNISPIY

SEQ ID NO: 181 - DNA, 1905 bp, Artificial Sequence; identical to SEQ ID NO: 33
  Description of Artificial Sequence: Synthetic sequence based on Bacillus thuringiensis

SEQ ID NO: 182 - protein, 634 aa, Artificial Sequence; identical to SEQ ID NO: 34
  Description of Artificial Sequence: Synthetic sequence based on Bacillus thuringiensis

SEQ ID NO: 183 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaagcccaatcgttcacgagtcaggactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactccggtggaatctcaagtggcgatattggagcttcaccattcaaccagaactttaactgcagcacattcacccctcctttgcttacgccattcgttagatcctggctcgacagtggaagtgatcgagaaggagtcgctactgtgaccaactggcagacagagagtttcgagacaacactcggtctacgatcaggagcattcaccgcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 184 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDMLEFRTYMFLNVFEYVSIWSLFKYQSLLVSSGANLYASGSGPQQAQSFTSQDWPFLYSLFQVNSNYVLNGFSGARLSNTFPNIVGLPGSTTTHALLAARVNYSGGISSGDIGASPFNQNFNCSTFTPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 185 - DNA, 1905 bp, Artificial Sequence; identical to SEQ ID NO: 125
  Description of Artificial Sequence: Synthetic sequence based on Bacillus thuringiensis

SEQ ID NO: 186 - protein, 634 aa, Artificial Sequence; identical to SEQ ID NO: 126
  Description of Artificial Sequence: Synthetic sequence based on Bacillus thuringiensis

SEQ ID NO: 187 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaaccacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatatgcaagtggaagtggagttactaatacacaatcgttcacgagtcaagactggccattcctgtacagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 188 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNHTRDYSNYCINTYQTAFKGLNTRLHDTLEFRTYMFLNVFEYVSIWSLFKYQSLLVSSGANLYASGSGVTNTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 189 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactatggggtttgatcttcccctccggtagcacaaatctcatgcaggatatactccgtgagaccgagaagttcctgaaccagcgactgaacacggacaccttggcacgagttaatgctgaattgacaggtctacgggcaaatgtcgaggagttcaatcgccaagttgacaacttcctaaatcccaatagaaacgcagtgcctttgtctattacgtcgtccgtcaacacgatgcagcagctattcttgaaccggttacctcaattccagatgcaaggctaccaattgttgttactcccgttattcgcccaagctgctaatatgcacctgagcttcatcagggatgtcatcctaaatgcagacgagtggggcatatcggcagctacactacgtacttatagggattacctgaagaactacacgagggaatactcaaactactgtatcaacacctaccagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactaccctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagtcaacaattggtattcgatccggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 190 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELWGLIFPSGSTNLMQDILRETEKFLNQRLNTDTLARVNAELTGLRANVEEFNRQVDNFLNPNRNAVPLSITSSVNTMQQLFLNRLPQFQMQGYQLLLLPLFAQAANMHLSFIRDVILNADEWGISAATLRTYRDYLKNYTREYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYPGGISSGDIGASPFNQNFNCSTFLPPLLTPFVRSWLDSGSDREGVATVTNWQTESFESTIGIRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINMGNVVASSNSDVPLDINVTLNSGTQFDLMNIMLVPTNISPLY

SEQ ID NO: 191 - DNA, 1905 bp, Artificial Sequence
  Description of Artificial Sequence: Synthetic sequence based on Bacillus thuringiensis
atgggaaactctgtccttaattccagtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcagggtatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgagaggataccaatctttgttactcccgttattcgcccaagctgctaatcttcacctgagcttcatcagggacgtcatcctaaatgcagacgagtggggcatatcggcagctacactacgtacttatcaggactacctgaggaactacacgcgtgactactcaaactactgtatcaacacctatcagtccgccttcaaaggcctgaatacagggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacagcaaggtacactctcaggggtaatggaaactcttacaacctatacttgcgtgtctccagcataggcaattcaactatcagggttaccatcaacggtcgagcgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 192 - protein, 634 aa, Artificial Sequence
  Description of Artificial Sequence: Synthetic sequence based on Bacillus thuringiensis
MGNSVLNSSRTTICDAYNVAAHDPFSFQHKSLDTVQREWTEWKKNNHSLYLDPIVGTVASFLLKKVGSLVGKRILSELRSLIFPSGSTNLMQGILRETEKFLNQRLNTDTLARVNAELTGLQANVEEFNRQVDNFLNPNRNAVPLSITSSVNTMQQLFLNRLPQFQMRGYQSLLLPLFAQAANLHLSFIRDVILNADEWGISAATLRTYQDYLRNYTRDYSNYCINTYQSAFKGLNTGLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRAYTATNVNTTTNNDGVNDNGARFSDINIGNVVASSNSDVPLDINVTLNSGTQFDLMNIMLVPTNISPLY

SEQ ID NO: 193 - DNA, 1906 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactggacactgttcaggaggagtggatggagtggaagaaggacaatcattcgctatatattgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacgcggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacatgatgcagcagctattcttgaaccggttacctcaattccagctacgtgatccccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacgtcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacgacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggccgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttgcgttgaactcaggcacacagttcgatttgatgaacgtcatgtttgttccgacaaacctaccaccattgtattagg

SEQ ID NO: 194 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYIDPIVGTVASFLLKKVGSLVGKRILSELRSLIFPSGSTNLMQDILRETEKFLNQRLNADTLARVNAELTGLQANVEEFNRQVDNFLNPNRNAVPLSITSSVNMMQQLFLNRLPQFQLRDPQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNVVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNDIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVALNSGTQFDLMNVMFVPTNLPPLY

SEQ ID NO: 195 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactatggaatttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctatatcccaatcgtaacgccgtgcctttgtctattacgtcgtccgtcaacacgatgcagcagctattcttgaaccggttacctcaattccaagtgcaaggctaccaattgttgttactcccgttattcgcccaagctgctaatcttcacctgagcttcatcagggatgtcatcctgaatgcagacgagtggggcatatcggcagctacactacgtacttatagggattacctgaagaactacacgcgtgactactcaaactactgtatcaacacctatcagtccgccttcaaaggcctgaatgcaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacccctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggctaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttcaactcaggcacacagttcgatttgatgaacatcatgctggtaccgacaaacattagcccattgtattag

SEQ ID NO: 196 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELWNLIFPSGSTNLMQDILRETEKFLNQRLNTDTLARVNAELTGLQANVEEFNRQVDNFLYPNRNAVPLSITSSVNTMQQLFLNRLPQFQVQGYQLLLLPLFAQAANLHLSFIRDVILNADEWGISAATLRTYRDYLKNYTRDYSNYCINTYQSAFKGLNARLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRATINGRVYTATNVNTTTNNDGVNDNGARFSDINMGNVVASSNSDVPLDINVTFNSGTQFDLMNIMLVPTNISPLY

SEQ ID NO: 197 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaaccattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagttaggtgaatatcaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccatccctgtatagcttgttccaggtcaactccaactacgtgctgaacggcttctcaggtgttcgattgtcccagactttcccaaacatcgttggacttccaggaacaactacgactcatgccttgctggctgcacgagtcaactactctggtggagtttcaagtggcgatattggagcccgaacagccggccagaacttcaactgcagcacattcctgcctcctttgctttcgccattcgttagatcctggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgctaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcatacagttcgatttgatgaacatcatgtttgttccgacaaacctaccaccattgtattag

SEQ ID NO: 198 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQLGEYQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPSLYSLFQVNSNYVLNGFSGVRLSQTFPNIVGLPGTTTTHALLAARVNYSGGVSSGDIGARTAGQNFNCSTFLPPLLSPFVRSWLDSGSDRGGVNTVTNWQTESFETTLGLRSGAFTARGNSNYFPDYFIRNISGVPLVARNEDLRRPLHYNQIRNIESPSGTPGGARAYMVSVHNRKNNIYAVHENGTMIHLAPEDYTGFTISPIHATQVNNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGIQFDLMNIMFVPTNLPPLY

SEQ ID NO: 199 - DNA, 1905 bp, Artificial Sequence; identical to SEQ ID NO: 121
  Description of Artificial Sequence: Synthetic sequence based on Bacillus thuringiensis

SEQ ID NO: 200 - protein, 634 aa, Artificial Sequence; identical to SEQ ID NO: 6
  Description of Artificial Sequence: Synthetic sequence based on Bacillus thuringiensis

SEQ ID NO: 201 - DNA, 1905 bp, Artificial Sequence; identical to SEQ ID NO: 33
  Description of Artificial Sequence: Synthetic sequence based on Bacillus thuringiensis

SEQ ID NO: 202 - protein, 634 aa, Artificial Sequence; identical to SEQ ID NO: 34
  Description of Artificial Sequence: Synthetic sequence based on Bacillus thuringiensis

SEQ ID NO: 203 - DNA, 1905 bp, Artificial Sequence; identical to SEQ ID NO: 141
  Description of Artificial Sequence: Synthetic sequence based on Bacillus thuringiensis

SEQ ID NO: 204 - protein, 634 aa, Artificial Sequence; identical to SEQ ID NO: 18
  Description of Artificial Sequence: Synthetic sequence based on Bacillus thuringiensis

SEQ ID NO: 205 - DNA, 1905 bp, Artificial Sequence; identical to SEQ ID NO: 179
  Description of Artificial Sequence: Synthetic sequence based on Bacillus thuringiensis

SEQ ID NO: 206 - protein, 634 aa, Artificial Sequence; identical to SEQ ID NO: 180
  Description of Artificial Sequence: Synthetic sequence based on Bacillus thuringiensis

SEQ ID NO: 207 - DNA, 1905 bp, Artificial Sequence; identical to SEQ ID NO: 195
  Description of Artificial Sequence: Synthetic sequence based on Bacillus thuringiensis

SEQ ID NO: 208 - protein, 634 aa, Artificial Sequence; identical to SEQ ID NO: 196
  Description of Artificial Sequence: Synthetic sequence based on Bacillus thuringiensis

SEQ ID NO: 209 - DNA, 1905 bp, Artificial Sequence; identical to SEQ ID NO: 121
  Description of Artificial Sequence: Synthetic sequence based on Bacillus thuringiensis

SEQ ID NO: 210 - protein, 634 aa, Artificial Sequence; identical to SEQ ID NO: 6
  Description of Artificial Sequence: Synthetic sequence based on Bacillus thuringiensis

SEQ ID NO: 211 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactatggggtttgatcttcccctccggtagcacaaatctcatgcaggacatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgcagtgcctttgtctattacgtcgtccgttaacacgatgcagcagctattcttgagccggttacctcaattccaagtgcaaggctaccaattgttgttactcccgttattcgcccaagctgctaatatgcacctgagcttcatcagggatgtcgtcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagtcaacaattggtattcgatgcggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcgggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttcaactcaggcacacagttcgatttgatgaacatcatgctggtaccgacaaacattagcccaatctattag

SEQ ID NO: 212 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELWGLIFPSGSTNLMQDILRETEKFLNQRLNTDTLARVNAELTGLQANVEEFNRQVDNFLNPNRNAVPLSITSSVNTMQQLFLSRLPQFQVQGYQLLLLPLFAQAANMHLSFIRDVVLNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFESTIGIRCGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLGGNGNSYNLYLRVSSIGNSTIRVTINGRVYTATNVNTTTNNDGVNDNGARFSDINMGNVVASSNSDVPLDINVTFNSGTQFDLMNIMLVPTNISPIY

SEQ ID NO: 213 - DNA, 1905 bp, Artificial Sequence
  Description of Artificial Sequence: Synthetic sequence based on Bacillus thuringiensis
atgggacacaacgtccttaattccggtcgtaccacaatatgtgatgcacacaacgtggccgctcacgaccctttctcattccagcgcaaatcactagacactgttcaggaggggtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacgggtctacaggcaagtgtcgaggagttcaatcgccaagttgacaacttcctaaatcccaatcgtaacgccgtgcctttgtctgttacgtcgtccgtcaacacgatgcagcagctattcttgaaccggttacctcaattccagttgcgtggacaccaattgttgttactcccgttattcgcccaagctgctaatcttcacctgagcttcatcagggatgtcatcctaaatgcagacgagtggggcatatcggcagctacactacgtacttatcgaaaccatctgaggaactacacgcgtgactactcaaactactgtatcaacacctatcagactgccttccgtggcctgaatacaaggctccacgatatgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtcccagactttcccaaacatcgttggacttccaggaacaactacgactcatgccttgctggctgcacgagtcaactactctggtggagtttcaagtggcgatattggagcttcgccgttcaaccagaacttcagttgcagcacattcctgcctcctttgcttacgccattcgttagatcctggctcgacagtggaagtgatcgagggggagttaatactgtgaccaactggcagacagagagtttcgagacaacactcggtctacgatcaggagcattcacagcgagaggaaacagcaactacttcccagactacttcatccgaaacatctctggagtacctctagtcgttaggaacgaagaccttcgtcgtcctctgcactacaatcagatcaggaacattgagtcaccttcaggtacacctggtggagcacgagcatacatggtctcagttcacaaccgtaagaacaacatctacgcagttcatgagaacggaacgatgatccacttggctccagaggactacaccggatttacaatcagtcctatccacgccactcaggcgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggttaccatcaacggccgagtgtacacagctacaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 214 - protein, 634 aa, Artificial Sequence
  Description of Artificial Sequence: Synthetic sequence based on Bacillus thuringiensis
MGHNVLNSGRTTICDAHNVAAHDPFSFQRKSLDTVQEGWMEWKKDNHSLYVDPIVGTVASFLLKKVGSLVGKRILSELRSLIFPSGSTNLMQDILRETEKFLNQRLNTDTLARVNAELTGLQASVEEFNRQVDNFLNPNRNAVPLSVTSSVNTMQQLFLNRLPQFQLRGHQLLLLPLFAQAANLHLSFIRDVILNADEWGISAATLRTYRNHLRNYTRDYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLSQTFPNIVGLPGTTTTHALLAARVNYSGGVSSGDIGASPFNQNFSCSTFLPPLLTPFVRSWLDSGSDRGGVNTVTNWQTESFETTLGLRSGAFTARGNSNYFPDYFIRNISGVPLVVRNEDLRRPLHYNQIRNIESPSGTPGGARAYMVSVHNRKNNIYAVHENGTMIHLAPEDYTGFTISPIHATQANNQTRTFISEKFGNQGDSLRFEQSNTTARYTLRGNGNSYNLYLRVSSIGNSTIRVTINGRVYTATNVNTTTNNDGVNDNGARFSDINIGNVVASDNSNVPLDINVTLNSGTQFDLMNIMFVPTNLPPLY

SEQ ID NO: 215 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcgctagacactgttcagagggaatggactgagtggaagaagaacaatcattcgctatatctcgacccgatcgttggaaccgtggcttcattcttactcaagaaggtcggttctctcgtcggtaagaggattctctcggaactatggaatttgatcttcccctccggtagcacaaatctcatgcaggatatactccgtgagaccgagcaattcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgagggactactcaaactactgtatcaacacctatcagtccgccttcaaaggcctgaatacaaggctccacgatacgttgaagtttcggacatacatgttcctgaacgtgttcgagtatgtctccatctggtcgcttttcaagtaccagtcattgctggtctcgtcaggtgctaacctatacgcaagtggaagtggaccccagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgtcagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctggtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccgggtttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaacccttacaacctatacttgcgtgtctccagcataggcaattcaactatcagggttaccatcaacggtcgggtgtacacagctacaaacgtcaataccaccactaacaacgatggtgtaaacgacaatggtgctcgcttcagcgacatcaacatgggaaacgtagtcgcaagcagtaacagtgacgtacctctggacattaacgttacgttcaactcaggcacacagttcgatttgatgaacatcatgctggtaccgacaaacattagcccaatctattag

SEQ ID NO: 216 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELWNLIFPSGSTNLMQDILRETEQFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLKFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNPYNLYLRVSSIGNSTIRVTINGRVYTATNVNTTTNNDGVNDNGARFSDINMGNVVASSNSDVPLDINVTFNSGTQFDLMNIMLVPTNISPIY

SEQ ID NO: 217 - DNA, 1905 bp, Artificial Sequence
  Description of Artificial Sequence: Synthetic sequence based on Bacillus thuringiensis
atgggaaactctgtccttaattccggtcgtaccacaatatgtgatgcgtacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattcagagtgcaaggctaccaattgttgttactcccgttattcgcccaagctgctaatcttcacctgagcttcatcagggatgtcgtcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacgctcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggggcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacgcagctacaaacgtcaataccaccactaacaacgatggtgtaaacgacaatggtgctcgcttcagcgacatcaacatcggaaacgtagtcgcaagcagtaacagtgacgtacctctggacattaacgttacgttcaactcaggcacacagttcgatttgatgaacatcatgctggtaccgacaaacattagcccaatctattag

SEQ ID NO: 218 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFRVQGYQLLLLPLFAQAANLHLSFIRDVVLNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYAATNVNTTTNNDGVNDNGARFSDINIGNVVASSNSDVPLDINVTFNSGTQFDLMNIMLVPTNISPIY

SEQ ID NO: 219 - DNA, 1905 bp, Artificial Sequence; identical to SEQ ID NO: 157
  Description of Artificial Sequence: Synthetic sequence based on Bacillus thuringiensis

SEQ ID NO: 220 - protein, 634 aa, Artificial Sequence; identical to SEQ ID NO: 158
  Description of Artificial Sequence: Synthetic sequence based on Bacillus thuringiensis

SEQ ID NO: 221 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggggtttgatcttcccctccggtagcacaaatctcatgcaggatatactccgtgagaccgagaagttcctgaaccagcgactggacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccaaatgcaaggctaccaattgttgttactcccgttattcgcccaagctgctaatcttcacctgagcttcatcagggatgtcgtcctaaatgcagacgagtggggcgtatcggcagctacactacgtacttatagggattacctgaagaactacacgacggactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcggtggacttccaggaagcactacgactcatgccttgctggctgcacgagtcaactactctggtggaatctcaagtggcgatattggggcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacggtccggagcattcacagcaagaggaaacagcaactacttcccagactacttcatccgaaacatctctggagtacctctagtcgttaggaacgaagaccttcgtcggcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctgtccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaaccatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccaatctattag

SEQ ID NO: 222 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRGLIFPSGSTNLMQDILRETEKFLNQRLDTDTLARVNAELTGLQANVEEFNRQVDNFLNPNRNAVPLSITSSVNTMQQLFLNRLPQFQMQGYQLLLLPLFAQAANLHLSFIRDVVLNADEWGVSAATLRTYRDYLKNYTTDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIGGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPVHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPIY

SEQ ID NO: 223 - DNA, 1905 bp, Artificial Sequence; identical to SEQ ID NO: 165
  Description of Artificial Sequence: Synthetic sequence based on Bacillus thuringiensis

SEQ ID NO: 224 - protein, 634 aa, Artificial Sequence; identical to SEQ ID NO: 166
  Description of Artificial Sequence: Synthetic sequence based on Bacillus thuringiensis

SEQ ID NO: 225 - DNA, 1905 bp, Artificial Sequence; identical to SEQ ID NO: 33
  Description of Artificial Sequence: Synthetic sequence based on Bacillus thuringiensis

SEQ ID NO: 226 - protein, 634 aa, Artificial Sequence; identical to SEQ ID NO: 34
  Description of Artificial Sequence: Synthetic sequence based on Bacillus thuringiensis

SEQ ID NO: 227 - DNA, 1905 bp, Artificial Sequence; identical to SEQ ID NO: 127
  Description of Artificial Sequence: Synthetic sequence based on Bacillus thuringiensis

SEQ ID NO: 228 - protein, 634 aa, Artificial Sequence; identical to SEQ ID NO: 128
  Description of Artificial Sequence: Synthetic sequence based on Bacillus thuringiensis

SEQ ID NO: 229 - DNA, 1905 bp, Artificial Sequence; identical to SEQ ID NO: 195
  Description of Artificial Sequence: Synthetic sequence based on Bacillus thuringiensis

SEQ ID NO: 230 - protein, 634 aa, Artificial Sequence; identical to SEQ ID NO: 196
  Description of Artificial Sequence: Synthetic sequence based on Bacillus thuringiensis

SEQ ID NO: 231 - DNA, 1905 bp, Artificial Sequence
  Description of Artificial Sequence: Synthetic sequence based on Bacillus thuringiensis
atgggacacaacgtccttaattccggtcgtaccacaatatgtgatgcatacaacgtggccgctcacgaccctttctcattccagcacaaatcactagacactgttcaggaggagtggatggagtggaagaaggacaatcattcgctatatgttgacccgatcgttggaaccgtggcttcattcttgctcaagaaggtgggttctctcgttggtaagaggattctctcggaactaaggagcttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatccgcacccaactatctctcacttgtctattacgtcgtccgtcaacacgatgcagcagctattcttgaaccggttaccacaattccagatgcaaggctaccaattgttgttactcccggtattcgcccaagctgctaatcttcacctgagcttcatcagggatgtcatcctaaatgcagacgagtggggcatatcggcagctacactacgtacttatcgaaaccatctgaggaactacacgcgtgactactcaaaccactgtatcaacacctatcagactgccttccgtggcctgaatacaaggctccacgatatgttggagtttcggacatacatgtccctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccagctacgtgctgaacggcttctcaggtgctcgattgtcccagactttcccaaacatcgttggacttccaggaacaactacgactcatgccttgctggctgcacgagtcaactactctggtggagtttcaagtggcgatattggggcttcgccgttcaaccagaacttcagttgcagcacattcctgcctcctttgcttacgccattcgttagatcccggctcgacagtggaagtgatcgagggggagttaatactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatcagatcaggaacattgagtcacctccaggtacacctggtggagcacgagcatacatggtctcagttcacaaccgtaagaacaacatctacgcagttcatgagaacggaacgatgatccacttggctccagaggactacaccggatttacaatcagtcctatccacgccactcgggtgaacaaccagactcgaacgttcatcagtgagaagtttggaaaccaaggcgattctctgaggtttgagcagagtaataccacggcaaggtacactctcaggggtaatggaaactcttacaacctatacttgcgtgtctccagcataggcaattcaactatcagggtcaccatcaacggtcgagtgtacacagctgcaaacgtcaataccaccactaacaacgatggtgtaaacgacaatggtgctcgcttcagcgacatcaacatcggaaacgtagtcgcgagcgacaacagcaacgtacctctggacattaacgttacgttgaactcaggcacacagttcgatttgatgaacatcatgtttgttccgacaaacctaccaccattgtattag

SEQ ID NO: 232 - protein, 634 aa, Artificial Sequence
  Description of Artificial Sequence: Synthetic sequence based on Bacillus thuringiensis
MGHNVLNSGRTTICDAYNVAAHDPFSFQHKSLDTVQEEWMEWKKDNHSLYVDPIVGTVASFLLKKVGSLVGKRILSELRSLIFPSGSTNLMQDILRETEKFLNQRLNTDTLARVNAELTGLQANVEEFNRQVDNFLNPHPTISHLSITSSVNTMQQLFLNRLPQFQMQGYQLLLLPVFAQAANLHLSFIRDVILNADEWGISAATLRTYRNHLRNYTRDYSNHCINTYQTAFRGLNTRLHDMLEFRTYMSLNVFEYVSIWSLFKYQSLLVSSGANLYASGSGPQQTQSFTSQDWPFLYSLFQVNSSYVLNGFSGARLSQTFPNIVGLPGTTTTHALLAARVNYSGGVSSGDIGASPFNQNFSCSTFLPPLLTPFVRSRLDSGSDRGGVNTVTNWQTESFETTLGLRSGAFTARGNSNYFPDYFIRNISGVPLVVRNEDLRRPLHYNQIRNIESPPGTPGGARAYMVSVHNRKNNIYAVHENGTMIHLAPEDYTGFTISPIHATRVNNQTRTFISEKFGNQGDSLRFEQSNTTARYTLRGNGNSYNLYLRVSSIGNSTIRVTINGRVYTAANVNTTTNNDGVNDNGARFSDINIGNVVASDNSNVPLDINVTLNSGTQFDLMNIMFVPTNLPPLY

SEQ ID NO: 233 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacgatcattcgctatatctcgacccgatcgttggaaccgtggcttcattcttgctcaagaaggtgggttctctcgttggtaagaggattctctcggaactatggaatttgatcttcccctccggtagcacaaatctcatgcaggatatactccgtgagaccgaggagttcctgaaccagcgactgaacacggacaccttggcacgagttaatgctgaattgacaggtctacaggcaaatgtcgaggagttcaatcgccaagttgacaacttcctaaatcccaatcaaaacgcagtgcctttgtctattacgtcgtccgtcaacacgatgcagcagctattcttgaaccggttacctcaattccaaatgcaaggctaccaattgttgttactcccgttattcgcccaagctgctaatatgcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgctagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcgacatcggaaacgtagtcgcaagcagtaacagtgacgtacctctggacattaacgttacgttcaactcaggcacacagttcgatttgatgaacatcatgctggtaccgacaaacattagcccattgtattag

SEQ ID NO: 234 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNDHSLYLDPIVGTVASFLLKKVGSLVGKRILSELWNLIFPSGSTNLMQDILRETEEFLNQRLNTDTLARVNAELTGLQANVEEFNRQVDNFLNPNQNAVPLSITSSVNTMQQLFLNRLPQFQMQGYQLLLLPLFAQAANMHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDIDIGNVVASSNSDVPLDINVTFNSGTQFDLMNIMLVPTNISPLY

SEQ ID NO: 235 - DNA, 1905 bp, Artificial Sequence; identical to SEQ ID NO: 195
  Description of Artificial Sequence: Synthetic sequence based on Bacillus thuringiensis

SEQ ID NO: 236 - protein, 634 aa, Artificial Sequence; identical to SEQ ID NO: 196
  Description of Artificial Sequence: Synthetic sequence based on Bacillus thuringiensis

SEQ ID NO: 237 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatcaggactacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcggtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacgcagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 238 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQDYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTIGPIHATQVNNQTRTFISEKFGNQGDSLRFEQNNTTARYTLRGNGNSYNLYLRVSSIGNSTIRVTINGRVYAATNVNTTTNNDGVNDNGARFSDINIGNVVASSNSDVPLDINVTLNSGTQFDLMNIMLVPTNISPLY

SEQ ID NO: 239 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgaggagttcctgaaccagcgactgaacacggacaccttggcacgagttaatgctgaattgacaggtctacaggcaaatgtcgaggagttcaatcgccaagttgacaacttcctaaatcccaacttggacaccgtgcccttgtctattacgtcgtccgtcaacacgatgcagcagctattcttgaaccggttacctcaattccagatgcaaggctaccaactgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaggactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 240 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETEEFLNQRLNTDTLARVNAELTGLQANVEEFNRQVDNFLNPNLDTVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 241 - DNA, 1905 bp, Artificial Sequence; identical to SEQ ID NO: 23
  Description of Artificial Sequence: Synthetic sequence based on Bacillus thuringiensis

SEQ ID NO: 242 - protein, 634 aa, Artificial Sequence; identical to SEQ ID NO: 24
  Description of Artificial Sequence: Synthetic sequence based on Bacillus thuringiensis

SEQ ID NO: 243 - DNA, 1905 bp, Artificial Sequence; identical to SEQ ID NO: 195
  Description of Artificial Sequence: Synthetic sequence based on Bacillus thuringiensis

SEQ ID NO: 244 - protein, 634 aa, Artificial Sequence; identical to SEQ ID NO: 196
  Description of Artificial Sequence: Synthetic sequence based on Bacillus thuringiensis

SEQ ID NO: 245 - DNA, 1905 bp, Artificial Sequence; identical to SEQ ID NO: 221
  Description of Artificial Sequence: Synthetic sequence based on Bacillus thuringiensis

SEQ ID NO: 246 - protein, 634 aa, Artificial Sequence; identical to SEQ ID NO: 222
  Description of Artificial Sequence: Synthetic sequence based on Bacillus thuringiensis

SEQ ID NO: 247 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagcaattcctgaaccagcgactgaacacggacaccttggcacgagttaatgctgaattgacaggtctacaggcaaatgtcgaggagttcaatcgccaagttgacaacttcctaaatcccaatcgtaacaccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgagggactactcaaactactgtatcaacacctatcagtccgccttcaaaggcctgaatacaaggctccacgatacgttggagtttcgaacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgcatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacccctggacattaacgttacgttgaactcaggcacacagttcgatttgatgaacatcatgctggtaccgacaaacattagcccaatctattag

SEQ ID NO: 248 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRNLIFPSGSTNLMQDILRETEQFLNQRLNTDTLARVNAELTGLQANVEEFNRQVDNFLNPNRNTVPLSITSSVNTMQQLFLNRLPQFQMQGYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLHSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPIY

SEQ ID NO: 249 - DNA, 1905 bp, Artificial Sequence; identical to SEQ ID NO: 33
  Description of Artificial Sequence: Synthetic sequence based on Bacillus thuringiensis

SEQ ID NO: 250 - protein, 634 aa, Artificial Sequence; identical to SEQ ID NO: 34
  Description of Artificial Sequence: Synthetic sequence based on Bacillus thuringiensis

SEQ ID NO: 251 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaggttgacaacctcctaaatcccaatcgtaacgccgtgcctttgtctattacgtcgtccgtcaacacgatgcagcagctattcttgaaccggttacctcaattccagatgcaaggctaccaattgttgttactcccgttactcgcccaagctgctaatcttcacctgagcttcatcagggatgtcatcctaaatgcagacgagtggggcatatcggcagctacactacgtacttatagggactacctgaggaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggaccccagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 252 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELTGLQANVEEFNRQVDNLLNPNRNAVPLSITSSVNTMQQLFLNRLPQFQMQGYQLLLLPLLAQAANLHLSFIRDVILNADEWGISAATLRTYRDYLRNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 253 - DNA, 1905 bp, Artificial Sequence
  Description of Artificial Sequence: Synthetic sequence based on Bacillus thuringiensis
atgggaaactctgtccttaactccggtcgtgccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaagttcctgaaccagcgactgaacacggacaccttggcacgagttaatgctgaattgacaggtctacaggcaaatgtcgaggagttcaatcgccaagttgacaacttcctaaatcccaatcgtaacgccgtgcctttgtctattacgtcgtccgtcaacacgatgcagcagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatcaggactacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcggtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacgcagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 254 - protein, 634 aa, Artificial Sequence
  Description of Artificial Sequence: Synthetic sequence based on Bacillus thuringiensis
MGNSVLNSGRATICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELTGLQANVEEFNRQVDNFLNPNRNAVPLSITSSVNTMQQLFLNRLPQFQMQGYQLLLLPLFAQAANLHLSFIRDVILNADEWGISAATLRTYQDYLKNYTRDYSNYCINTYQTAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTIGPIHATQVNNQTRTFISEKFGNQGDSLRFEQNNTTARYTLRGNGNSYNLYLRVSSIGNSTIRVTINGRVYAATNVNTTTNNDGVNDNGARFSDINIGNVVASSNSDVPLDINVTLNSGTQFDLMNIMLVPTNISPLY

SEQ ID NO: 255 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcattagacactgttcggagggaatggactgagtggaagaagaacaatcattcgccatatctcgacccgatcgttggaaccgtggcttcattcttgctcaagaaggtgggttctctcgttggtaagaggattctctcggaactaaggaacttgatcttcccctccggtagcacaaatctcatgcaggatatactccgtgagaccgagaagttcctgaaccagcgactgaacacggacaccttggcacgagttaatgctgaattgacaggcctacaggcaaatgtcgaggagttcaatcgccaagttgacaacttcctaaatccccctttgagcattgtgcccttgtctattacgtcgtccgtcaacacgatgcagcagctattcttgaaccggttacctcaattccagatgcaacaataccaactcttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctaccagtccgccttcaaaggcctgaatacaaggctccacgatacgttggagtttcggacatacatgttcctgaacgtgttcgagtatgtctccatctggtcgcttttcaagtaccagtcactgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 256 - protein, 634 aa, Artificial Sequence
  Description of Artificial Sequence: Synthetic sequence based on Bacillus thuringiensis
MGNSVLNSGRTTICDAYNVAAHDPFSFQHKSLDTVRREWTEWKKNNHSPYLDPIVGTVASFLLKKVGSLVGKRILSELRNLIFPSGSTNLMQDILRETEKFLNQRLNTDTLARVNAELTGLQANVEEFNRQVDNFLNPPLSIVPLSITSSVNTMQQLFLNRLPQFQMQQYQLLLLPLFAQAANLHLSFIRDVILNADEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 257 - DNA, 1905 bp, Artificial Sequence
  Description of Artificial Sequence: Synthetic sequence based on Bacillus thuringiensis
atgggaaactctgtccttaattccggtcgtaccacaatatgtgatgcatacaacgtggcagctcacgaccctttctcattccagcacaaatcactagacactgttcagagggaatggactgagtggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggacatactccgtgagaccgagaagttcctgaaccagcgactgaacacggacaccttggcacgagttaatgctgaattggaaggtctacaggcaaatgtcgaggagttcaatcgccaagttgacaacttcctaaatccccctagagacattgtgcccttgtctattacgtcgtccgtcaacacgatgcaacagctattcttgaaccggttacctcaattccagatgcaaggctaccaattgttgttactcccgttattcgcccaagctgctaatcttcacctgagcttcatcagggatgtcatcctaaatgcagacgagtggggcatatcggcagctacactacgtacttatagggattacctgaagaactacacgcgtgactactcaaactactgtatcaacacctatcagacagccttcaaaggcctgaatacaaggctccacgatacgttggagtttcggacatacatgttcctgaacgtgttcgagtatgtctccatctggtcgcttttcaagtaccagtcattgctggtctcgtcaggtgccaacctatacgcaagcggaagtggacctcagcaaacccaatcgttcacgggtcaagactggccattcctgtatagcttgttccaggtcaactccaactacgtgctgaacggcttctcaggtgctcgattgtccaacactttcccaaacatcgtcggacttccaggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcgtcagtgagaagtttggaaaccaaggcgattctctgaggtttgagcagaacaataccacggcaaggtacactctcaggggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 258 - protein, 634 aa, Artificial Sequence
  Description of Artificial Sequence: Synthetic sequence based on Bacillus thuringiensis
MGNSVLNSGRTTICDAYNVAAHDPFSFQHKSLDTVQREWTEWKKNNHSLYLDPIVGTVASFLLKKVGSLVGKRILSELRSLIFPSGSTNLMQDILRETEKFLNQRLNTDTLARVNAELEGLQANVEEFNRQVDNFLNPPRDIVPLSITSSVNTMQQLFLNRLPQFQMQGYQLLLLPLFAQAANLHLSFIRDVILNADEWGISAATLRTYRDYLKNYTRDYSNYCINTYQTAFKGLNTRLHDTLEFRTYMFLNVFEYVSIWSLFKYQSLLVSSGANLYASGSGPQQTQSFTGQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFVSEKFGNQGDSLRFEQNNTTARYTLRGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 259 - DNA, 1905 bp, Artificial Sequence
  Description of Artificial Sequence: Synthetic sequence based on Bacillus thuringiensis
atgggaaactctgtccttgattccggtcgtaccacaatatgtgatgcatacaacgtggcagctcacgaccctttctcattccagcacaaaccactagacactgttcagagggaatggactgagcggaagaagaacaatcattcgctatatctcgacccgatcgttggaaccgtggcttcattcttgctcaagaaggtgggttctctcgttggtaagaggattctctcggaactaaggtccttgatcttcccctccggtagcacaaatctcatgcaggatatactccgtgagaccgagaagctcctgaaccagcgactgaacacggacaccttggcacgagttaatgctgaattggaaggtctacaggcaaatgtcgaggagttcaatcgccaagttgacaacttcctaaatcccaatcgtaacgccgtgcctttgtctattacgtcgtccgtcaacacgatgcagcagctattcttgaaccggttaccccaattccagatgcaaggctaccaattgttgttactcccgttattcgcccaagctgctaatcttcacctgagcttcatcagggatgtcatcctaaatgcaggcgagtggggcatatcggcagctacactacgtacttatagggattacctgaagaactacacgcgtgactactcaaactactgtatcaacacctatcagtccgccttcaaaggcctgaatacaaggctccacgatacgttggagtttcggacatacatgttcctgaacgtgttcgagtatgtctccatctggtcgcttttcaagtaccagtcattgctggtctcgtcaggtgctaacctatacgcaagtggaagtggacctcagcaaacccaatcgttcacgagtcaagactggccattcctgtatagcttgttccaggtcaactccaactacgtgctgaacggcttctcaggtgctcgattgtccaacactttcccaaacatcgttggacttccgggaagcactacgactcatgccttgctggctgcacgagtcaactactctggtggaatctcaagtggcgatattggagcttcaccattcaaccagaacttcaactgcagcacattcctgcctcctttgcttacgccattcgttagatcctggctcgacagtggaagtgatcgagaaggagtcgctactgtgaccaactggcagacagagagtttcgagacaacactcggtctacgatcaggagcattcacagcaagaggaaacagcaactacttcccagactacttcatccgaaacatctctggagtacctctagtcgttaggaacgaagaccttcgtcgtcctctgcactacaatgagatcaggaacattgcctcaccttcaggtacacctggtggagcacgagcatacatggtctcagttcacaaccgtaagaacaacatccatgcagttcatgagaacggatcaatgatccacttggctccaaacgactacaccggatttacaatcagtcctatccacgccactcaggtgaacaaccagactcgaacgttcatcagtgagaagtttggaaaccaaggcgattctctgaggtttgagcagaacaataccacggcaaggtacactctcaagggtaatggaaactcttacaacctatacttgcgtgtctccagcataggcaattcaactatcagggttaccatcaacggtcgagtgtacacagctacaaacgtcaataccaccactaacaacgatggtgtaaacgacaatggtgctcgcttcagcgacatcaacatcggaaacgtagtcgcaagcagtaacagtgacgtacctctggacattaacgttacgttgaactcaggcacacagttcgatttgatgaacatcatgctggtaccgacaaacattagcccattgtattag

SEQ ID NO: 260 - protein, 634 aa, Artificial Sequence
  Description of Artificial Sequence: Synthetic sequence based on Bacillus thuringiensis
MGNSVLDSGRTTICDAYNVAAHDPFSFQHKPLDTVQREWTERKKNNHSLYLDPIVGTVASFLLKKVGSLVGKRILSELRSLIFPSGSTNLMQDILRETEKLLNQRLNTDTLARVNAELEGLQANVEEFNRQVDNFLNPNRNAVPLSITSSVNTMQQLFLNRLPQFQMQGYQLLLLPLFAQAANLHLSFIRDVILNAGEWGISAATLRTYRDYLKNYTRDYSNYCINTYQSAFKGLNTRLHDTLEFRTYMFLNVFEYVSIWSLFKYQSLLVSSGANLYASGSGPQQTQSFTSQDWPFLYSLFQVNSNYVLNGFSGARLSNTFPNIVGLPGSTTTHALLAARVNYSGGISSGDIGASPFNQNFNCSTFLPPLLTPFVRSWLDSGSDREGVATVTNWQTESFETTLGLRSGAFTARGNSNYFPDYFIRNISGVPLVVRNEDLRRPLHYNEIRNIASPSGTPGGARAYMVSVHNRKNNIHAVHENGSMIHLAPNDYTGFTISPIHATQVNNQTRTFISEKFGNQGDSLRFEQNNTTARYTLKGNGNSYNLYLRVSSIGNSTIRVTINGRVYTATNVNTTTNNDGVNDNGARFSDINIGNVVASSNSDVPLDINVTLNSGTQFDLMNIMLVPTNISPLY

SEQ ID NO: 261 - protein, 632 aa, Bacillus thuringiensis
MNNVLNNGRTTICDAYNVVAHDPFSFEHKSLDTIRKEWMEWKRTDHSLYVAPIVGTVSSFLLKKVGSLIGKRILSELWGLIFPSGSTNLMQDILRETEQFLNQRLNTDTLARVNAELEGLQANIREFNQQVDNFLNPTQNPVPLSITSSVNTMQQLFLNRLPQFRVQGYQLLLLPLFAQAANMHLSFIRDVVLNADEWGISAATLRTYQNYLKNYTTEYSNYCINTYQTAFRGLNTRLHDMLEFRTYMFLNVFEYVSIWSLFKYQSLLVSSGANLYASGSGPQQTQSFTSQDWPFLYSLFQVNSNYVLNGFSGARLTQTFPNIGGLPGTTTTHALLAARVNYSGGVSSGDIGAVFNQNFSCSTFLPPLLTPFVRSWLDSGSDRGGVNTVTNWQTESFESTLGLRCGAFTARGNSNYFPDYFIRNISGVPLVVRNEDLRRPLHYNEIRNIESPSGTPGGLRAYMVSVHNRKNNIYAVHENGTMIHLAPEDYTGFTISPIHATQVNNQTRTFISEKFGNQGDSLRFEQSNTTARYTLRGNGNSYNLYLRVSSLGNSTIRVTINGRVYTASNVNTTTNNDGVNDNGARFLDINMGNVVASDNTNVPLDINVTFNSGTQFELMNIMFVPTNLPPIY

What is claimed is:

1. An isolated polypeptide comprising SEQ ID NO: 134 said polypeptide having insecticidal activity.

2. The isolated polypeptide of claim 1, wherein the polypeptide has insecticidal activity against Dipteran or Lepidopteran insects.

3. An isolated polypeptide comprising an amino acid sequence that is at least 9900 identical to the amino acid sequence of SEQ ID NO: 134, wherein said polypeptide has an insecticidal activity.

4. The isolated polypeptide of claim 3, wherein the polypeptide comprises at least one amino acid substitution selected from the group consisting of H2, S7, Q27, E36, D44, D51, A58, V69, R78, N79, K99, I118, V124, E125, R129, N138, R139, A141, T162, Q165, M166, L183, I192, H211, R213, R217, D218, V324, I386, T399, S405, Q445, I551, S587, L610, and L631, wherein the amino acid position corresponds to the amino acid sequence of SEQ ID NO: 134 and wherein said isolated polypeptide is at least 99% identical to the amino acid sequence of SEQ ID NO: 134.

5. The isolated polypeptide of claim 3, wherein the polypeptide has insecticidal activity against Dipteran or Lepidopteran insects.

6. The isolated polypeptide of claim 3, wherein the polypeptide is encoded by a nucleic acid molecule comprising a nucleotide sequence that is at least 95% identical to either of SEQ ID NOS: 133 or 147, wherein said polypeptide has insecticidal activity.

7. A composition comprising the isolated and purified polypeptide of SEQ ID NO: 134 and an agent, wherein the agent is selected from the group consisting of spreader-sticker adjuvants, stabilizing agents, insecticidal agents, diluents, surfactants, emulsifiers, and dispersants: said polypeptide having insecticidal activity.

8. The composition of claim 7, wherein the composition further comprises isolated cells.

9. The composition of claim 8, wherein the cells are whole or lysed.

10. The composition of claim 9, wherein the cells are in suspension or are pelleted.

11. The composition of claim 7, wherein the composition further comprises a spore-crystal complex of *Bacillus thuringiensis*.

* * * * *

UNITED STATES PATENT AND TRADEMARK OFFICE
CERTIFICATE OF CORRECTION

PATENT NO. : 7,737,117 B2
APPLICATION NO. : 11/675729
DATED : June 15, 2010
INVENTOR(S) : Ericka Bermudez et al.

It is certified that error appears in the above-identified patent and that said Letters Patent is hereby corrected as shown below:

Column 53, Line 18, cancel the text beginning with claim reference numeral '2' and insert the following claims:

-- 2. An isolated polypeptide comprising an amino acid sequence that is at least 99% identical to the amino acid sequence of SEQ ID NO: 134, wherein said polypeptide having insecticidal activity.

3. The isolated polypeptide of claim 2, wherein the polypeptide comprises at least one amino acid selected from the group consisting of H2, S7, Q27, E36, D44, D51, A58, V69, R78, N79, K99, T118, V124, E125, R129, N138, R139, A141, T162, Q165, M166, L183, I192, H211, R213, R217, D218, V324, I386, T399, S405, Q445, I551, S587, L610, and L631, wherein the amino acid position corresponds to the amino acid sequence of SEQ ID NO: 134 and wherein said isolated polypeptide is at least 99% identical to the amino acid sequence of SEQ ID NO: 134.

4. The isolated polypeptide of claim 1, wherein the polypeptide has insecticidal activity against Dipteran or Lepidopteran insects.

5. A composition comprising the isolated and purified polypeptides of SEQ ID NO: 134 and an agent, wherein the agent is selected from the group consisting of spreader-sticker adjuvants, stabilizing agents, insecticidal agents, diluents, surfactants, emulsifiers, and dispersants; said polypeptide having insecticidal activity. --

Column 54, Line 15, cancel the text beginning with claim reference numeral '6' and insert the following claims:

-- 6. The composition of claim 5, wherein the composition further comprises isolated cells.

7. The composition of claim 6, wherein the cells are whole or lysed.

8. The composition of claim 7, wherein the cells are in suspension or are pelleted.

9. The composition of claim 5, wherein the composition further comprises a spore-crystal complex of Bacillus thuringiensis.

10. The isolated polypeptide of claim 2, wherein the polypeptide has insecticidal activity against Dipteran or Lepidopteran insects.

11. The isolated polypeptide of claim 2, wherein the polypeptide is encoded by a nucleic acid molecule comprising a nucleotide sequence that is at least 95% identical to either of SEQ ID NOS: 133 or 147, wherein said polypeptide has insecticidal activity. --

Signed and Sealed this

Twenty-eighth Day of September, 2010

David J. Kappos
*Director of the United States Patent and Trademark Office*